United States Patent 12,508,308 (INFLUENZA mRNA VACCINES) - sequence listing, part 12

SEQ ID NO: 45701 - RNA, 1410 nt, Artificial Sequence
  neuraminidase__InfluenzaA__ABG67226
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccccgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45702 - RNA, 1410 nt, Artificial Sequence; identical to SEQ ID NO: 45666
  neuraminidase__InfluenzaA__ABG67248

SEQ ID NO: 45703 - RNA, 1413 nt, Artificial Sequence; identical to SEQ ID NO: 45332
  neuraminidase__InfluenzaA__ABG67480

SEQ ID NO: 45704 - RNA, 1413 nt, Artificial Sequence
  neuraminidase__InfluenzaA__ABG67494
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaauggugucuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 45705 - RNA, 1410 nt, Artificial Sequence
  neuraminidase__InfluenzaA__ABG67505
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagccgauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45706 - RNA, 1410 nt, Artificial Sequence; identical to SEQ ID NO: 45705
  neuraminidase__InfluenzaA__ABG67516

SEQ ID NO: 45707 - RNA, 1410 nt, Artificial Sequence; identical to SEQ ID NO: 45671
  neuraminidase__InfluenzaA__ABG67527

SEQ ID NO: 45708 - RNA, 1410 nt, Artificial Sequence
  neuraminidase__InfluenzaA__ABG67538
augaauccaaaucaaaagauaauaacaauuggcucuguuucucucaccauugccacaauaugcuuccuuaugcaaauugccauccugguaacuacuguaacauugcauuucaagcaguacgaaugcaacucccccccaaacaaccaaguaaugcugugugaaccaacaacaauagaaagaaacacaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucauagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45709 - RNA, 1410 nt, Artificial Sequence
  neuraminidase__InfluenzaA__ABG67549
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauugcagauaaauaggcaaguuauaguugaaagagguaacagguccgguuauucugguauuuucuccguugaaggcaaaagcugcaucaaucggugcuuuuauguggaguugauaaggggaaggaaagaggaaaaugaagucugguggaccucaaacaguauuguuguguuuuguggcaccucagguacauauggaacaggcucauggccugauggggcggauaucaaucucaugccuauauaa

SEQ ID NO: 45710 - RNA, 1410 nt, Artificial Sequence; identical to SEQ ID NO: 45095
  neuraminidase__InfluenzaA__ABG67560

SEQ ID NO: 45711 - RNA, 1410 nt, Artificial Sequence; identical to SEQ ID NO: 45095
  neuraminidase__InfluenzaA__ABG67571

SEQ ID NO: 45712 - RNA, 1410 nt, Artificial Sequence
  neuraminidase__InfluenzaA__ABG67582
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucaucuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcuaagcaugucgaggagugcuccuguuacccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45713 - RNA, 1410 nt, Artificial Sequence
  neuraminidase__InfluenzaA__ABG67593
augaauccaaaucaaaagauaauaacaauuggcucuguuucucucaccauugccacaauaugcuuccuuaugcaaauugccauccuggucacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucaacgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45714 - RNA, 1410 nt, Artificial Sequence; identical to SEQ ID NO: 45095
  neuraminidase__InfluenzaA__ABG67604

SEQ ID NO: 45715 - RNA, 1410 nt, Artificial Sequence; identical to SEQ ID NO: 45095
  neuraminidase__InfluenzaA__ABG67615

SEQ ID NO: 45716 - RNA, 1410 nt, Artificial Sequence
  neuraminidase__InfluenzaA__ABG67626
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcaaggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45717 - RNA, 1410 nt, Artificial Sequence; identical to SEQ ID NO: 45095
  neuraminidase__InfluenzaA__ABG67637

SEQ ID NO: 45718 - RNA, 1410 nt, Artificial Sequence
  neuraminidase__InfluenzaA__ABG67648
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucaucuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuacccucgauauccuggugucagaugugucugcagagacaacuggaaaggcuccaauaggcccauuguagauauaaauguaaaagauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauga

SEQ ID NO: 45719 - RNA, 1410 nt, Artificial Sequence
  neuraminidase__InfluenzaA__ABG67659
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuagggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaucggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45720 - RNA, 1410 nt, Artificial Sequence
  neuraminidase__InfluenzaA__ABG67670
augaauccaaaucaaaagauaauaacaauuggcucuguuucucucacuauugccacaauaugcuuccuuaugcaaauugccauccugauaacuacuguaacauugcauuucaagcaauaugaaugcaacucccccccaaacaaccaaguaaugcugugugaaccaacaauaauagagagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucaggaagagcugauacuaaaauacuauucauugaagaggggaaaaucguucauauuagcccacugucaggaagugcucagcaugucgaggagugcuccugcuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugauguguggaugggaagaacgaucagcgagaaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45721 - RNA, 1410 nt, Artificial Sequence; identical to SEQ ID NO: 45247
  neuraminidase__InfluenzaA__ABG79944

SEQ ID NO: 45722 - RNA, 1413 nt, Artificial Sequence; identical to SEQ ID NO: 45563
  neuraminidase__InfluenzaA__ABG79955

SEQ ID NO: 45723 - RNA, 1410 nt, Artificial Sequence
  neuraminidase__InfluenzaA__ABG79966
augaauccaaaucaaaagauaauaacaauuggcucuguuucucucaccauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacaggaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucagggagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccagaauccuaacaaugagaaagggagucauggagugaaagguugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45724 - RNA, 1410 nt, Artificial Sequence
  neuraminidase__InfluenzaA__ABG79977
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaagcaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45725 - RNA, 1410 nt, Artificial Sequence; identical to SEQ ID NO: 45617
  neuraminidase__InfluenzaA__ABG79988

SEQ ID NO: 45726 - RNA, 1410 nt, Artificial Sequence
  neuraminidase__InfluenzaA__ABG79999
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagauccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45727 - RNA, 1410 nt, Artificial Sequence
  neuraminidase__InfluenzaA__ABG80010
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggaaagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacuggacaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45728 - RNA, 1410 nt, Artificial Sequence
  neuraminidase__InfluenzaA__ABG80021
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacaggaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45729 - RNA, 1410 nt, Artificial Sequence
  neuraminidase__InfluenzaA__ABG80032
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcaucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucacauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggagcggacaucaaucucaugccuauauaa

SEQ ID NO: 45730 - RNA, 1410 nt, Artificial Sequence; identical to SEQ ID NO: 45619
  neuraminidase__InfluenzaA__ABG80043

SEQ ID NO: 45731 - RNA, 1410 nt, Artificial Sequence
  neuraminidase__InfluenzaA__ABG80054
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaagaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45732 - RNA, 1410 nt, Artificial Sequence
  neuraminidase__InfluenzaA__ABG80065
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucuaaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45733 - RNA, 1410 nt, Artificial Sequence
  neuraminidase__InfluenzaA__ABG80076
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguauuugacuaacaccaccauagagaaagaaauaugccccaaacuggcagaauacagaaauuggucaaaaccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaaguuauuggaggcugguccaaaccuaacuccaaauugcagauaaauaggcaagucauaguugacagagguaauagguccgguuauucugguauuuucucuguugaaggcaaaaacugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45734 - RNA, 1410 nt, Artificial Sequence
  neuraminidase__InfluenzaA__ABG80087
augaauccaaaucaaaagauaauaacaauuggcucuguuucucucacuauugccacaauaugcuuucuuaugcaaauugccguccugguaacuacuguaacauugcauuucaagcaauaugagugcaacucccccccaagcaaccaaguaaugcugugugaaccaacaauaauagaaagaaacauaacagagauaguguaccugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauggcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcgucuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45735 - RNA, 1410 nt, Artificial Sequence
  neuraminidase__InfluenzaA__ABG80098
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaaugcaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaaaccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45736 - RNA, 1410 nt, Artificial Sequence
  neuraminidase__InfluenzaA__ABG80109
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucagaacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45737 - RNA, 1410 nt, Artificial Sequence
  neuraminidase__InfluenzaA__ABG80120
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcauuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45738 - RNA, 1410 nt, Artificial Sequence
  neuraminidase__InfluenzaA__ABG80131
augaauccaaaucaaaagauaauaacaauuggcucuguuucucucacuauugccacaauaugcuuucuuaugcaaauugccaucaugguaaccacuguaacauugcauuucaaacaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuuccaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45739 - RNA, 1410 nt, Artificial Sequence; identical to SEQ ID NO: 45626
  neuraminidase__InfluenzaA__ABG80142

SEQ ID NO: 45740 - RNA, 1410 nt, Artificial Sequence
  neuraminidase__InfluenzaA__ABG80153
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaaacaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaaaccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45741 - RNA, 1410 nt, Artificial Sequence
  neuraminidase__InfluenzaA__ABG80164
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauacggaacaggcucauggccugauggggcggacaucaaucucaugccuauauaa

SEQ ID NO: 45742 - RNA, 1413 nt, Artificial Sequence; identical to SEQ ID NO: 45423
  neuraminidase__InfluenzaA__ABG80186

SEQ ID NO: 45743 - RNA, 1410 nt, Artificial Sequence; identical to SEQ ID NO: 44673
  neuraminidase__InfluenzaA__ABG80197

SEQ ID NO: 45744 - RNA, 1410 nt, Artificial Sequence; identical to SEQ ID NO: 45292
  neuraminidase__InfluenzaA__ABG80219

SEQ ID NO: 45745 - RNA, 1410 nt, Artificial Sequence
  neuraminidase__InfluenzaA__ABG80230
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucagaaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45746 - RNA, 1410 nt, Artificial Sequence; identical to SEQ ID NO: 45095
  neuraminidase__InfluenzaA__ABG80241

SEQ ID NO: 45747 - RNA, 1410 nt, Artificial Sequence; identical to SEQ ID NO: 45095
  neuraminidase__InfluenzaA__ABG80252

SEQ ID NO: 45748 - RNA, 1410 nt, Artificial Sequence; identical to SEQ ID NO: 45679
  neuraminidase__InfluenzaA__ABG80263

SEQ ID NO: 45749 - RNA, 1410 nt, Artificial Sequence
  neuraminidase__InfluenzaA__ABG80274
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaggcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45750 - RNA, 1410 nt, Artificial Sequence
  neuraminidase__InfluenzaA__ABG80285
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgacccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauga

SEQ ID NO: 45751 - RNA, 1410 nt, Artificial Sequence; identical to SEQ ID NO: 44870
  neuraminidase__InfluenzaA__ABG80296

SEQ ID NO: 45752 - RNA, 1410 nt, Artificial Sequence
  neuraminidase__InfluenzaA__ABG80307
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaagagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45753 - RNA, 1410 nt, Artificial Sequence
  neuraminidase__InfluenzaA__ABG80318
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45754 - RNA, 1410 nt, Artificial Sequence
  neuraminidase__InfluenzaA__ABG80329
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauaggucugguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45755 - RNA, 1410 nt, Artificial Sequence
  neuraminidase__InfluenzaA__ABG80340
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 45756 - RNA, 1410 nt, Artificial Sequence
  neuraminidase__InfluenzaA__ABG80351
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacagauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45757 - RNA, 1410 nt, Artificial Sequence
  neuraminidase__InfluenzaA__ABG80373
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagagauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45758 - RNA, 1410 nt, Artificial Sequence
  neuraminidase__InfluenzaA__ABG80384
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45759 - RNA, 1410 nt, Artificial Sequence
  neuraminidase__InfluenzaA__ABG80395
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaauguguuuguaucaauggaacuuguacaguaguaaugacugauggaagugcuucaaaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauauguccgguuauucugguauuuucucuguugaaggcaaaagcugcaucaaucggugcuuuuacguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45760 - RNA, 1410 nt, Artificial Sequence; identical to SEQ ID NO: 45689
  neuraminidase__InfluenzaA__ABG80406

SEQ ID NO: 45761 - RNA, 1410 nt, Artificial Sequence; identical to SEQ ID NO: 45689
  neuraminidase__InfluenzaA__ABG80417

SEQ ID NO: 45762 - RNA, 1410 nt, Artificial Sequence
  neuraminidase__InfluenzaA__ABG80428
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagggaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45763 - RNA, 1410 nt, Artificial Sequence; identical to SEQ ID NO: 45416
  neuraminidase__InfluenzaA__ABG88292

SEQ ID NO: 45764 - RNA, 1413 nt, Artificial Sequence
  neuraminidase__InfluenzaA__ABG88314
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcaggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucugcaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccaaacacuggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45765 - RNA, 1413 nt, Artificial Sequence
  neuraminidase__InfluenzaA__ABG88325
augaauccaaaucaaaaaauaauaaccauuggaucaaccaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaguguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaacaggauacaucugcagugggguguucggugacaauccgcgucccaaagauggagaaggcagcuguaauccagugacugcugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45766 - RNA, 1413 nt, Artificial Sequence
  neuraminidase__InfluenzaA__ABG88336
augaauccaaaucagaaaauaauaaccauuggaucaaucuguauggcaaucgggauaauuagucuaauauugcagauaggaaauauuauuucaauauggguuagccacucaauccaaacuggaaaucaaaaccacacuggaauaugcaaccaaagaaucaucaccuaugaaaauagcaccuggguaaaucaaacauauguuaauauuaacaacacuaacguuguugcuggaaaggacacaacuucagugacacuagccggcaauucaucucuuuguccuguccgugggugggcuauauacagcaaagacaacagcauaagaauugguuccaaaggagauguuuuugucauaagagaaccuuuuauaucauguucucacuuggaaugcagaaccuuuuuucuaacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucuggaccagaugauggagcaguggcuguacuaaaauacaauggcauaauaacugaaaccauaaaaaguuggaggaagcgaauauuaagaacacaagagucugaaugugucuguguaaacgguucauguuuuaccauaaugaccgauggcccaaguaaugggccggccucguacaagaucuucaaaaucgagaaggggaaaauuacuaaaucaauagaguuggaugcacccaauucucacuacgaggaauguuccuguuacccagacaccggcacagugaugugugugugcagagacaauuggcaugguucgaaucgaccuugggugucuuuuaaucaaaaccuggauuaucaauuaggauacaucugcagugggauuuucggugacaauccgcgucccaaagauggaaaaggcagcugugguccaguaacuguugauggagcagacggaguaaagggauuuucauacagauaugguaaugguguuuggauaggaaggacuaaaaguaacagcuccagaaagggauuugagaugauuugggauccuaacggauggacagauaccgauaguaauuucuuagugaaacaggauguaguggcaaugacugauuggucaggguacagcggaaguuucguucaacauccugaacuaacaggauuggacuguaugaggccuugcuucuggguugaauuaaucagaggacgaccuagagaaacgacaacaaucuggacuagugggagcagcauuucuuuuuguggcgugaauagugauacuguaaauuggucuuggccagacggugccgaguugccauucaccauugacaaguag

SEQ ID NO: 45767 - RNA, 1413 nt, Artificial Sequence
  neuraminidase__InfluenzaA__ABG88347
augaauccaaaucagaaaauaauaaccauuggaucaaucuguauggcaaucgggauaauuggucuaauauugcagauaggaaauauuauuucaauauggguuagccacucaauccaaacuggaagucaaaaccacacuggaauaugcaaccaaagaaucaucaccuaugaaaauagcaccuggguaaaucaaacauauguuaauauuaacaacacuaacguuguugcuggaaaggacacaacuucagugacacuagccggcaauucaucucuuuguccuguccgugggugggcuauauacagcaaagacaacagcauaagaauugguuccaaaggagauguuuuugucauaagagaaccuuuuauaucauguucucacuuggaaugcagaaccuuuuuucuaacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucuggaccagaugauggagcaguggcuguacuaaaauacaauggcauaauaacugaaaccauaaaaaguuggaggaagcgaauauuacgaacacaagagucugaaugugucuguguaaacgguucauguuuuaccauaaugaccgauggcccaaguaaugggccggccucguacaagaucuucaaaaucgagaaggggaaaauuacuaaaucaauagaguuggaugcacccaauucucacuacgaggaauguuccuguuacccagacaccggcacagugaugugugugugcagagacaauuggcaugguucgaaucgaccuugggugucuuuuaaucaaaaccuggauuaucaauuaggauacaucugcagugggauuuucggugacaauccgcgucccaaagauggaaaaggcagcugugguccaguaacuguugauggagcagacggaguaaagggguuuucauacagauaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugaacuaacaggauuggacuguaugaggccuugcuucuggguugaauuaaucagaggacgaccuagagaaacgacaacaaucuggacuagugggagcagcauuucuuuuuguggcgugaauagugauacuguaaauuggucuuggccagacggugccgaguugccauucaccauugacaaguag

SEQ ID NO: 45768 - RNA, 1410 nt, Artificial Sequence
  neuraminidase__InfluenzaA__ABG88358
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugauaaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagaccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuauguaugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45769 - RNA, 1410 nt, Artificial Sequence; identical to SEQ ID NO: 45617
  neuraminidase__InfluenzaA__ABG88369

SEQ ID NO: 45770 - RNA, 1410 nt, Artificial Sequence; identical to SEQ ID NO: 45617
  neuraminidase__InfluenzaA__ABG88380

SEQ ID NO: 45771 - RNA, 1410 nt, Artificial Sequence; identical to SEQ ID NO: 45617
  neuraminidase__InfluenzaA__ABG88391

SEQ ID NO: 45772 - RNA, 1410 nt, Artificial Sequence; identical to SEQ ID NO: 45619
  neuraminidase__InfluenzaA__ABG88402

SEQ ID NO: 45773 - RNA, 1410 nt, Artificial Sequence
  neuraminidase__InfluenzaA__ABG88413
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuauguguguucaggacuuguuggagacacacccagaaaaaacgacagcuccagcaguagcuauugccggaaaccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45774 - RNA, 1410 nt, Artificial Sequence
  neuraminidase__InfluenzaA__ABG88424
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45775 - RNA, 1410 nt, Artificial Sequence
  neuraminidase__InfluenzaA__ABG88435
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguaccugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45776 - RNA, 1410 nt, Artificial Sequence
  neuraminidase__InfluenzaA__ABG88446
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45777 - RNA, 1410 nt, Artificial Sequence
  neuraminidase__InfluenzaA__ABG88457
augaauccaaaucaaaagauaauaacaauuggcucuguuucucucacuacugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauuaaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuauguaugcucaggacuuguuggagacacacccagaaaaaacgacagcuccagcaguagcuauugccagaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaagagcugcaucaaucggugcuuuuauguggaguugauuaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45778 - RNA, 1410 nt, Artificial Sequence
  neuraminidase__InfluenzaA__ABG88468
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauucucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaacccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguaccuauggaacaggcucauggccugauggggcggacaucaaucucaugccuauauaa

SEQ ID NO: 45779 - RNA, 1410 nt, Artificial Sequence
  neuraminidase__InfluenzaA__ABG88479
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgaugggaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45780 - RNA, 1410 nt, Artificial Sequence
  neuraminidase__InfluenzaA__ABG88490
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccauaguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45781 - RNA, 1410 nt, Artificial Sequence
  neuraminidase__InfluenzaA__ABG88501
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcacccuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45782 - RNA, 1410 nt, Artificial Sequence
  neuraminidase__InfluenzaA__ABG88512
augaauccaaaucaaaagauaauaacaauuggcucuguuucucucacuauugccacaauaugcuuucuuaugcaaauugccauccugguaacuacuguaacauugcauuucaagcaauaugaaugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugaaaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45783 - RNA, 1410 nt, Artificial Sequence; identical to SEQ ID NO: 45741
  neuraminidase__InfluenzaA__ABG88523

SEQ ID NO: 45784 - RNA, 1410 nt, Artificial Sequence
  neuraminidase__InfluenzaA__ABG88534
augaauccaaaucaaaagauaauaacaauuggcucuguuucucucacuauugccacaauaugcuuucuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaaacaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45785 - RNA, 1410 nt, Artificial Sequence
  neuraminidase__InfluenzaA__ABG88567
augaauccaaaucaaaagauaauaacgauugguucuguuucucucaccauugccacaauaugcuuccuuaugcaaauugccguccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45786 - RNA, 1410 nt, Artificial Sequence
  neuraminidase__InfluenzaA__ABG88600
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaaccagcagaauacagaaauuggucaaagccgcaauguaacauuacuggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccgaacccuauugaugaaugaguuggguguuccauuucauuugggaaccaagcaagugugcauagcaugguccagcucaaguugucacgauggaaaagcauggcugcauguuuguguaacgggugaugaugaaaaugcaacugcuagcuucauuuacaaugggaggcuuguagauaguauagguucaugguccaaaaaaauccucaggacccaggagucggaaugcguuuguaucaauggaacuuguacaguaguaaugacugauggaagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45787 - RNA, 1410 nt, Artificial Sequence; identical to SEQ ID NO: 45632
  neuraminidase__InfluenzaA__ABG88611

SEQ ID NO: 45788 - RNA, 1410 nt, Artificial Sequence
  neuraminidase__InfluenzaA__ABG88622
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaagguaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45789 - RNA, 1410 nt, Artificial Sequence
  neuraminidase__InfluenzaA__ABG88633
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaacccuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcugauaucaaucucaugccuauauaa

SEQ ID NO: 45790 - RNA, 1410 nt, Artificial Sequence; identical to SEQ ID NO: 45709
  neuraminidase__InfluenzaA__ABG88655

SEQ ID NO: 45791 - RNA, 1410 nt, Artificial Sequence; identical to SEQ ID NO: 45709
  neuraminidase__InfluenzaA__ABG88666

SEQ ID NO: 45792 - RNA, 1410 nt, Artificial Sequence; identical to SEQ ID NO: 45095
  neuraminidase__InfluenzaA__ABG88677

SEQ ID NO: 45793 - RNA, 1410 nt, Artificial Sequence; identical to SEQ ID NO: 45709
  neuraminidase__InfluenzaA__ABG88688

SEQ ID NO: 45794 - RNA, 1410 nt, Artificial Sequence
  neuraminidase__InfluenzaA__ABG88699
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggacccccuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45795 - RNA, 1410 nt, Artificial Sequence; identical to SEQ ID NO: 45173
  neuraminidase__InfluenzaA__ABG88710

SEQ ID NO: 45796 - RNA, 1410 nt, Artificial Sequence; identical to SEQ ID NO: 45754
  neuraminidase__InfluenzaA__ABG88721

SEQ ID NO: 45797 - RNA, 1410 nt, Artificial Sequence
  neuraminidase__InfluenzaA__ABG88732
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacuggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugaaagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45798 - RNA, 1410 nt, Artificial Sequence; identical to SEQ ID NO: 45758
  neuraminidase__InfluenzaA__ABG88743

SEQ ID NO: 45799 - RNA, 1410 nt, Artificial Sequence; identical to SEQ ID NO: 45758
  neuraminidase__InfluenzaA__ABG88754

SEQ ID NO: 45800 - RNA, 1410 nt, Artificial Sequence
  neuraminidase__InfluenzaA__ABG88765
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcuuugugaaccaacaauaauagaaagaaacauaacagagauaguguaucugaccaacaccaccauagagaaagaaguaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcaugguugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45801 - RNA, 1410 nt, Artificial Sequence
  neuraminidase__InfluenzaA__ABG88776
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcuaugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagugaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45802 - RNA, 1410 nt, Artificial Sequence; identical to SEQ ID NO: 45692
  neuraminidase__InfluenzaA__ABG88787

SEQ ID NO: 45803 - RNA, 1410 nt, Artificial Sequence
  neuraminidase__InfluenzaA__ABG88820
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaaaugccccaaacuagcagaauacagaaauuggucaaagccgcaauguaacauuacaggauuugcaccuuuuuccaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45804 - RNA, 1350 nt, Artificial Sequence
  neuraminidase__InfluenzaA__ABI16506
augaauccaaaucagaagauaauaaccauugggucaaucuguaugguaauuggaauaguuagcuuaauguuacaaauugggaacauggucucauuaugggucagucauucaauucagacagggaaucaacaccaaguugaaccaaucagcaauacuaauuuucuuacugagaaagcuguggcuucaguaacauuagcgggcaauucaucucuuugccccauuagaggaugggcuguacacaguaaggacaacaguauaaggauugguuccaaaggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugaaucuguugcuuggucagcaagugcuugccaugauggcaccaguugguugacaauuggaauuucuggcccagacaauggggcuguggcuguauugaaauacaauggaaugauaacagacaccaucaagaguuggaggaacaacauacugagaacucaagagucugaauguguauguguaaauggcucuugcuuuacuguaaugacugauggaccaaguaaugggcaggcaucauauaagaucuucaaaauggaaaaaggaaaagugguuaaaucagucgaauuggaugcuccuaauuaccacuaugaggaaugcuccuguuauccugaugccggcgaaaucacaugugugugcagggauaauuggcauggcucaaaucggccauggguaucuuucaaucaaaauuuggaguaucaaauaggauauauaugcagcggaguuuucggggacaauccacgccccaaugauggaacagguaguugugguccgguguccccuaauggggcauaugggguaaaaggguuuucauuuaaauacggcaaugguguuuggaucgggagaaccaaaagcccuaguuccaggagcggcuuugaaaugauuugggauccaaauggguggacugaaacggacaguagcuucucggugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauauccuuuugugguguaaauagugacacugugaguuggucuuggccagacggugcugaguugccauucaccauugacaaguaa

SEQ ID NO: 45805 - RNA, 1413 nt, Artificial Sequence
  neuraminidase__InfluenzaA__ABI20840
augaauccaaaucaaaaaauaauaaccauuggaucaaucaguauggcaauaggaauaauuagucuaauauugcaaauagggaauauuauuucaauaugggcuagccacucaauccaaacuggaagucaaaacuacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugccccauccguggaugggcuauauacacaaaagacaacagcauaagaauugguuccaaaggagauguuuuugucauaagagagccuuuuauaucauguucucauuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcuugccaugauggcuugggcuggcuaacaaucggaauuucugguccagauaauggagcaguggcuguacuaaaauacaacggcauaauaacugaaaccauaaaaaguuggaagaagcaaaucuuaagaacacaagagucugaaugugucugugugaacgguucauguuuuaccauaaugaccgauggcccgaguaauggggcugcaucguacagaaucuucaaaaucgagaaggggagaguuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggacccuaauggauggacagauaccgacagugauuucucaaugaaacaggaugucguggcaaugacugauuggucaggguacagcggaaguuuuguccaacauccugagcuaacaggauuggacuguaugagaccuugcuucuggguugaauuagucagagggcuaccuagagaaaauacaacaaucuggacuagugggagcagcauuucuuuuuguggcguaaauagcgagacugcaaacuggucuuggccagacggugcugaguugccauucaccauugacaaguag

SEQ ID NO: 45806 - RNA, 1413 nt, Artificial Sequence
  neuraminidase__InfluenzaA__ABI20862
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaacaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 45807 - RNA, 1413 nt, Artificial Sequence
  neuraminidase__InfluenzaA__ABI20873
augaauccaaaucaaaaaauaauaaccauuggaucgaucaguauggcaaucggaauaauuagucuaacauugcaaauaggaaauauuaucucaauaugggcuagccacucaauccaaacuggaagucaaaaccacacuggaauaugcaaccaaagaaucauuacauaugaaaauagcaccugggugaaucaaacauauguuaauauuaacaacacuaauguuguugcugaaaaggacaaaacuucagugacauuggccggcaauucaucucuuugcccuauccgugggugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagguucgaaucaguugcuuggucagcaaccgcaugccaugauggaauaggcuggcuaacaaucggaauuucugguccagauaauggagcaguggcuguacuaaaauacaacggcguaauaacugaaaccauaaaaaguuggaagaagcaaauauuaagaacacaagagucugaaugugucugugugaacgguucauguuuuaccauaaugaccgauggcccgaguaauggggccgccucguacagaaucuucaaaauugagaaggggaagauuaccaaaucaauagaauuggaugcacccaauuuucauuacgaggaauguuccuguuacccagacaccggcacagugaugugugugugcagggacaauuggcacgguucaaaucgaccuugggugucuuucaaucaaaaccuggauuaucaaauaggauauaucugcagugggguguucggugacaauccgcgucccaaagauggagaagguagcuguaauccagugacuguugauggagcagacggaguaaagggguuuucauacagauauggcaaugguguuuggauaggaaggacuaaaaguaacagacucagaaagggauuugagauaauuugggauccuaauggauggacagauaccgacagugauuuuucagugaaacaggaugucguggcaaugacugauuggucaggguacagcggaaguuucguucaacauccugagcuaacaggauuggacuguaugagaccuugcuucuggguugaauuagucagagggcuaccuagagaaaaugcaacaaucuggacuagugggagcagcauuucuuuuuguggcguaaauagugauacugcaaacuggucuuggccagacggugccgaguugccauucaccauugacaaguag

SEQ ID NO: 45808 - RNA, 1410 nt, Artificial Sequence
  neuraminidase__InfluenzaA__ABI20895
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauuaguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccugaauccuaacaaugaggaagggggucauggagugaaaggcugggccuuugaugauggaaaugacguguggaugggaagaacgaucagcgaaaaguuacgcucagguuaugaaaccuucaaggucauuggaggcugguccaaaccuaacuccaaauugcagauaaauaggcaagucauaguugacagagguaauagguccgguuauucugguauuuucucuguugaaggcaaaagcugcgucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45809 - RNA, 1410 nt, Artificial Sequence
  neuraminidase__InfluenzaA__ABI20906
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggggacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45810 - RNA, 1410 nt, Artificial Sequence; identical to SEQ ID NO: 45666
  neuraminidase__InfluenzaA__ABI20928

SEQ ID NO: 45811 - RNA, 1410 nt, Artificial Sequence; identical to SEQ ID NO: 45666
  neuraminidase__InfluenzaA__ABI20939

SEQ ID NO: 45812 - RNA, 1410 nt, Artificial Sequence; identical to SEQ ID NO: 45626
  neuraminidase__InfluenzaA__ABI20950

SEQ ID NO: 45813 - RNA, 1410 nt, Artificial Sequence
  neuraminidase__InfluenzaA__ABI20961
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagccauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45814 - RNA, 1410 nt, Artificial Sequence; identical to SEQ ID NO: 45331
  neuraminidase__InfluenzaA__ABI20983

SEQ ID NO: 45815 - RNA, 1410 nt, Artificial Sequence
  neuraminidase__InfluenzaA__ABI20994
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacauaauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45816 - RNA, 1410 nt, Artificial Sequence
  neuraminidase__InfluenzaA__ABI21005
augaauccaaaucaaaagauaauaacgauuggcucuguuucucucaccauugccacaauaugcuuccuuaugcaaauugccguccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuugcagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45817 - RNA, 1410 nt, Artificial Sequence; identical to SEQ ID NO: 45632
  neuraminidase__InfluenzaA__ABI21016

SEQ ID NO: 45818 - RNA, 1410 nt, Artificial Sequence
  neuraminidase__InfluenzaA__ABI21027
augaauccaaaucaaaggauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccccagguacauauggaacaggcucauggccugauggggcggauaucaaucucaugccuauauaa

SEQ ID NO: 45819 - RNA, 1410 nt, Artificial Sequence; identical to SEQ ID NO: 45095
  neuraminidase__InfluenzaA__ABI21038

SEQ ID NO: 45820 - RNA, 1410 nt, Artificial Sequence
  neuraminidase__InfluenzaA__ABI21049
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccgguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45821 - RNA, 1410 nt, Artificial Sequence
  neuraminidase__InfluenzaA__ABI21060
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaaccaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45822 - RNA, 1410 nt, Artificial Sequence
  neuraminidase__InfluenzaA__ABI21071
augaauccaaaucaaaagauaauaacgauuggcucuguuucucucaccauuuccacaauaugcuucuuuaugcaaauagccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugagugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45823 - RNA, 1410 nt, Artificial Sequence
  neuraminidase__InfluenzaA__ABI21082
augaauccaaaucaaaagauaauaacgauuggcucuguuucucucaccauuuccacaauaugcuucuuuaugcaaauugccaccuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 45824 - RNA, 1410 nt, Artificial Sequence
  neuraminidase__InfluenzaA__ABI21093
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45825 - RNA, 1410 nt, Artificial Sequence
  neuraminidase__InfluenzaA__ABI21104
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucuggccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45826 - RNA, 1410 nt, Artificial Sequence; identical to SEQ ID NO: 44870
  neuraminidase__InfluenzaA__ABI21115

SEQ ID NO: 45827 - RNA, 1410 nt, Artificial Sequence; identical to SEQ ID NO: 45755
  neuraminidase__InfluenzaA__ABI21126

SEQ ID NO: 45828 - RNA, 1410 nt, Artificial Sequence; identical to SEQ ID NO: 45824
  neuraminidase__InfluenzaA__ABI21137

SEQ ID NO: 45829 - RNA, 1410 nt, Artificial Sequence
  neuraminidase__InfluenzaA__ABI21148
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuauguaugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45830 - RNA, 1410 nt, Artificial Sequence
  neuraminidase__InfluenzaA__ABI21159
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccgguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45831 - RNA, 1410 nt, Artificial Sequence; identical to SEQ ID NO: 44870
  neuraminidase__InfluenzaA__ABI21170

SEQ ID NO: 45832 - RNA, 1410 nt, Artificial Sequence; identical to SEQ ID NO: 44870
  neuraminidase__InfluenzaA__ABI21181

SEQ ID NO: 45833 - RNA, 1413 nt, Artificial Sequence
  neuraminidase__InfluenzaA__ABI21192
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaacaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggagaaagcggauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuuccuuuuguggcguugauagugauacugcaaacuggucuuggccagacggugcugaguugccguucaucauugacaaauag

SEQ ID NO: 45834 - RNA, 1413 nt, Artificial Sequence
  neuraminidase__InfluenzaA__ABI21203
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcggauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuuccuuuuguggcguugauagugauacugcaaacuggucuuggccagacggugcugaguugccguucaccauugacaaauag

SEQ ID NO: 45835 - RNA, 1413 nt, Artificial Sequence
  neuraminidase__InfluenzaA__ABI21214
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacauaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 45836 - RNA, 1410 nt, Artificial Sequence
  neuraminidase__InfluenzaA__ABI21247
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaaaaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggaaugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45837 - RNA, 1410 nt, Artificial Sequence
  neuraminidase__InfluenzaA__ABI21258
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaaugguacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45838 - RNA, 1410 nt, Artificial Sequence
  neuraminidase__InfluenzaA__ABI21269
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuuggguaacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacuggacaugaugaaaaugcaacugcuagcuucauuuacgaugggaggcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45839 - RNA, 1410 nt, Artificial Sequence; identical to SEQ ID NO: 45838
  neuraminidase__InfluenzaA__ABI21280

SEQ ID NO: 45840 - RNA, 1410 nt, Artificial Sequence; identical to SEQ ID NO: 45756
  neuraminidase__InfluenzaA__ABI21302

SEQ ID NO: 45841 - RNA, 1410 nt, Artificial Sequence
  neuraminidase__InfluenzaA__ABI21313
augaauccaaaucaaaagauaauaacaauuggcucuguuucucucacuauugccacaauaugcuuccuuaugcaaauugccauccugguaacuacuguaacauugcauuucaagcaauaugagugcaauucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45842 - RNA, 1410 nt, Artificial Sequence; identical to SEQ ID NO: 45692
  neuraminidase__InfluenzaA__ABI21324

SEQ ID NO: 45843 - RNA, 1410 nt, Artificial Sequence; identical to SEQ ID NO: 45692
  neuraminidase__InfluenzaA__ABI21335

SEQ ID NO: 45844 - RNA, 1410 nt, Artificial Sequence; identical to SEQ ID NO: 45757
  neuraminidase__InfluenzaA__ABI21346

SEQ ID NO: 45845 - RNA, 1410 nt, Artificial Sequence
  neuraminidase__InfluenzaA__ABI21357
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaaaauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaagcugaagucugguggaccucaaacaguauuguuguguuuuguggcaccucagguacauauggaacaggcucauggccugauggggcggacaucaaucucaugccuauauaa

SEQ ID NO: 45846 - RNA, 1410 nt, Artificial Sequence
  neuraminidase__InfluenzaA__ABI21368
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacaccguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugagaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugucggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45847 - RNA, 1410 nt, Artificial Sequence; identical to SEQ ID NO: 45756
  neuraminidase__InfluenzaA__ABI21379

SEQ ID NO: 45848 - RNA, 1410 nt, Artificial Sequence; identical to SEQ ID NO: 45689
  neuraminidase__InfluenzaA__ABI21390

SEQ ID NO: 45849 - RNA, 1410 nt, Artificial Sequence
  neuraminidase__InfluenzaA__ABI21401
augaauccaaaucaaaagauaauaacaauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacagugguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagaucauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugauguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45850 - RNA, 1410 nt, Artificial Sequence
  neuraminidase__InfluenzaA__ABI21412
augaauccaaaucaaaagauaauaacaauuggcucuguuucucucacuauugccacaauaugcuuccuuaugcaaauugccauccugguaacuacuguaacauugcauuucaagcaauaugagugcaacccccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45851 - RNA, 1410 nt, Artificial Sequence; identical to SEQ ID NO: 45800
  neuraminidase__InfluenzaA__ABI21423

SEQ ID NO: 45852 - RNA, 1410 nt, Artificial Sequence; identical to SEQ ID NO: 45689
  neuraminidase__InfluenzaA__ABI21434

SEQ ID NO: 45853 - RNA, 1410 nt, Artificial Sequence; identical to SEQ ID NO: 45838
  neuraminidase__InfluenzaA__ABI21445

SEQ ID NO: 45854 - RNA, 1410 nt, Artificial Sequence; identical to SEQ ID NO: 45838
  neuraminidase__InfluenzaA__ABI21456

SEQ ID NO: 45855 - RNA, 1410 nt, Artificial Sequence; identical to SEQ ID NO: 45850
  neuraminidase__InfluenzaA__ABI21467

SEQ ID NO: 45856 - RNA, 1410 nt, Artificial Sequence; identical to SEQ ID NO: 45838
  neuraminidase__InfluenzaA__ABI21478

SEQ ID NO: 45857 - RNA, 1410 nt, Artificial Sequence; identical to SEQ ID NO: 45758
  neuraminidase__InfluenzaA__ABI21489

SEQ ID NO: 45858 - RNA, 1410 nt, Artificial Sequence; identical to SEQ ID NO: 45838
  neuraminidase__InfluenzaA__ABI21500

SEQ ID NO: 45859 - RNA, 1410 nt, Artificial Sequence
  neuraminidase__InfluenzaA__ABI21511
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaaugugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacgaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaagaucguuaauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 45860 - RNA, 1413 nt, Artificial Sequence
  neuraminidase__InfluenzaA__ABI21533
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucaugagagagccuuucauaucauguucucacuuggaaugcagaaccuuuuuucugacccaaggugcucuauuaaaugacaaacauucaaaugggaccguuaaggacagaaguccuuauagggccuuaaugaguuguccucuaggugaagcuccgucuccauauaauucaaaguuugaaucaguugcuuggucagcaagcgcaugccaugauggcaugggcugguuaacaaucggaauuucugguccagauaauggagcaguggcuguacuaaaauacaacggcauaauaacugaaaccauaaaaaguuggaaaaagcgaauauuaagaacacaagagucugaaugugucugugugaacgggucauguuuuaccauaaugaccgauggcccgaguaauggggccgccucguacaaaaucuucaagaucgaaaaggggaagguuauuaaaucaauagaguugaaugcacccaauucucauuaugaggaauguuccuguuacccagacacuggcacagugauguguguaugcagggacaacuggcacgguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacucagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 45861 - RNA, 1413 nt, Artificial Sequence; identical to SEQ ID NO: 45860
  neuraminidase__InfluenzaA__ABI21544

SEQ ID NO: 45862 - RNA, 1413 nt, Artificial Sequence; identical to SEQ ID NO: 45860
  neuraminidase__InfluenzaA__ABI21555

SEQ ID NO: 45863 - RNA, 1413 nt, Artificial Sequence; identical to SEQ ID NO: 45860
  neuraminidase__InfluenzaA__ABI21566

SEQ ID NO: 45864 - RNA, 1413 nt, Artificial Sequence; identical to SEQ ID NO: 45860
  neuraminidase__InfluenzaA__ABI21577

SEQ ID NO: 45865 - RNA, 1413 nt, Artificial Sequence
  neuraminidase__InfluenzaA__ABI22112
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacgaaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 45866 - RNA, 1410 nt, Artificial Sequence
  neuraminidase__InfluenzaA__ABI22162
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaguguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacguguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucuggcauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucgaucucaugccuauauaa

SEQ ID NO: 45867 - RNA, 1350 nt, Artificial Sequence
  neuraminidase__InfluenzaA__ABI23981
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaucaaucagcaauacuaaauuucuuacugagaaagcuguggcuucaguaacauuagcgggcaauucaucucuuugccccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccuuacagaacauugaugaguaguccugugggugaggcucccuccccauauaacucaagauuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacccaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccggugucccuuaacggggcauaugggguaaaaggguuuucauuuaaauacggcaaugguguuuggauugggagaaccaaaagcacuaauuccaggagcggcuuugaaaugauuugggauccaaauggauggacuggaacggacaguagcuuuucggugaagcaagauaucguagcaauaacugauuggucaggauauagcgggaguuuuguccagcauccagaauugacaggauuagauugcauaagaccuuguuucuggguugaguuaaucagagggcggccuaaagagagcacaauuuggaccagugggagcagcauaucuuuuugugguguaaauagugacacuguuaguuggucuuggccagacggugcugaguugccauucaccauugacaaguag

SEQ ID NO: 45868 - RNA, 1410 nt, Artificial Sequence
  neuraminidase__InfluenzaA__ABI26649
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacaucagguacauauggaacaggcucauggccugauggggcggacaucaaucucaugccuauauaa

SEQ ID NO: 45869 - RNA, 1413 nt, Artificial Sequence; identical to SEQ ID NO: 45554
  neuraminidase__InfluenzaA__ABI30370

SEQ ID NO: 45870 - RNA, 1410 nt, Artificial Sequence
  neuraminidase__InfluenzaA__ABI30392
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagacuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45871 - RNA, 1410 nt, Artificial Sequence
  neuraminidase__InfluenzaA__ABI30403
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaaugugaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45872 - RNA, 1410 nt, Artificial Sequence; identical to SEQ ID NO: 45247
  neuraminidase__InfluenzaA__ABI30414

SEQ ID NO: 45873 - RNA, 1410 nt, Artificial Sequence
  neuraminidase__InfluenzaA__ABI30425
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuagacuuuccgcugguggggacaucugggugacaagagaaccuuaugugucaugcgacccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45874 - RNA, 1410 nt, Artificial Sequence; identical to SEQ ID NO: 44870
  neuraminidase__InfluenzaA__ABI30436

SEQ ID NO: 45875 - RNA, 1410 nt, Artificial Sequence; identical to SEQ ID NO: 45873
  neuraminidase__InfluenzaA__ABI30447

SEQ ID NO: 45876 - RNA, 1410 nt, Artificial Sequence; identical to SEQ ID NO: 44870
  neuraminidase__InfluenzaA__ABI30458

SEQ ID NO: 45877 - RNA, 1410 nt, Artificial Sequence; identical to SEQ ID NO: 44870
  neuraminidase__InfluenzaA__ABI30469

SEQ ID NO: 45878 - RNA, 1410 nt, Artificial Sequence; identical to SEQ ID NO: 44870
  neuraminidase__InfluenzaA__ABI30480

SEQ ID NO: 45879 - RNA, 1410 nt, Artificial Sequence
  neuraminidase__InfluenzaA__ABI30491
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacaaagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45880 - RNA, 1410 nt, Artificial Sequence; identical to SEQ ID NO: 44870
  neuraminidase__InfluenzaA__ABI30502

SEQ ID NO: 45881 - RNA, 1410 nt, Artificial Sequence
  neuraminidase__InfluenzaA__ABI30513
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45882 - RNA, 1410 nt, Artificial Sequence; identical to SEQ ID NO: 45829
  neuraminidase__InfluenzaA__ABI30524

SEQ ID NO: 45883 - RNA, 1410 nt, Artificial Sequence; identical to SEQ ID NO: 44870
  neuraminidase__InfluenzaA__ABI30535

SEQ ID NO: 45884 - RNA, 1410 nt, Artificial Sequence
  neuraminidase__InfluenzaA__ABI30546
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaggugaugcugugugaaccaacaauaauagaaagaaacauaacagagauaguguaucugaccaacaccaccauagagaaggaaauaugccccaaacuagcggaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacuugcauucaaaugacacaguacaugauaggaccccuuaucggacccuauugaugagugaguuagguguuccauuucaucuggggaccaagcaagugugcauagcaugguccagcucaaguugucacgauggaaaagcauggaugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggaguguuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaacugcaucaaucggugcuuuuauguggaguugauaaggggaagaaaagaggaaacugaagucuuguggaccucaaacaguauuguuguguuuuguggcacaucagguacauauggaacaggcucauggccugauggggcggacaucaaucucaugccuauauaa

SEQ ID NO: 45885 - RNA, 1410 nt, Artificial Sequence; identical to SEQ ID NO: 44870
  neuraminidase__InfluenzaA__ABI30557

SEQ ID NO: 45886 - RNA, 1410 nt, Artificial Sequence
  neuraminidase__InfluenzaA__ABI30579
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccagcuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45887 - RNA, 1410 nt, Artificial Sequence
  neuraminidase__InfluenzaA__ABI30590
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaggcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45888 - RNA, 1410 nt, Artificial Sequence
  neuraminidase__InfluenzaA__ABI30601
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 45889 - RNA, 1410 nt, Artificial Sequence
  neuraminidase__InfluenzaA__ABI30612
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45890 - RNA, 1410 nt, Artificial Sequence; identical to SEQ ID NO: 45888
  neuraminidase__InfluenzaA__ABI30623

SEQ ID NO: 45891 - RNA, 1410 nt, Artificial Sequence
  neuraminidase__InfluenzaA__ABI30736
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccacaaugugacauuacaggauuugcaccuuuuucuaaggacaauucgauuaggcuuuccgcugguggggacaucugggugacaagagaaccuuaugugucaugcgacccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcguuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauagacaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45892 - RNA, 1410 nt, Artificial Sequence
  neuraminidase__InfluenzaA__ABI30758
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcuguaugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcuacauguuuguguaacgggggaugauaaaaaugcaacugcuagcuucauuuacaaugggaggcuuguagauaguauuguuucaugguccaaaaaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45893 - RNA, 1410 nt, Artificial Sequence
  neuraminidase__InfluenzaA__ABI30769
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaccccaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45894 - RNA, 1410 nt, Artificial Sequence; identical to SEQ ID NO: 45218
  neuraminidase__InfluenzaA__ABI30780

SEQ ID NO: 45895 - RNA, 1410 nt, Artificial Sequence
  neuraminidase__InfluenzaA__ABI30791
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccacaaugugacauuacaggauuugcaccuuuuucuaaggacaauucgauuaggcuuuccgcugguggggacaucugggugacaagagaaccuuaugugucaugcgacccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaauccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45896 - RNA, 1410 nt, Artificial Sequence
  neuraminidase__InfluenzaA__ABI30802
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuauguaucaugcgauccugacaaguguuaucaauuugcccuuggacagggaacaacacuaaacaacgugcauucaaaugacacaguacaugauaggaccccuuaccggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45897 - RNA, 1410 nt, Artificial Sequence; identical to SEQ ID NO: 45218
  neuraminidase__InfluenzaA__ABI30813

SEQ ID NO: 45898 - RNA, 1410 nt, Artificial Sequence
  neuraminidase__InfluenzaA__ABI30824
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuauguaucaugcgauccugacaaguguuaucaauuugcccuuggacagggaacaacacuaaacaacgugcauucaaaugacacaguacaugauaggaccccuuaccggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaagguugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45899 - RNA, 1410 nt, Artificial Sequence; identical to SEQ ID NO: 45898
  neuraminidase__InfluenzaA__ABI30835

SEQ ID NO: 45900 - RNA, 1410 nt, Artificial Sequence; identical to SEQ ID NO: 45893
  neuraminidase__InfluenzaA__ABI30846

SEQ ID NO: 45901 - RNA, 1410 nt, Artificial Sequence; identical to SEQ ID NO: 45689
  neuraminidase__InfluenzaA__ABI30857

SEQ ID NO: 45902 - RNA, 1410 nt, Artificial Sequence; identical to SEQ ID NO: 45692
  neuraminidase__InfluenzaA__ABI30868

SEQ ID NO: 45903 - RNA, 1350 nt, Artificial Sequence
  neuraminidase__InfluenzaA__ABI36157
augaauccaaaucagaagauaauaaccauuggaucaaucuguauggcaauuggaacaguuagcuuaauguuacaaauugggaacaugaucucaauaugggucagccauucaauucagacagggaaccaacaccaagcugaaucaaucagcaauacuaacccucuuacugagaaagcuguggcuucaguaacauuggcaggcaauucgucucuuugccccauuagaggaugggcuguacacaguaaggacaacaguauaaggaucgguuccaagggggauguguuuguuauuagagagccguucaucucaugcucccacucggaaugcagaacuuucuuuuugacucagggagccuugcugaaugacaagcacuccaacgagacugucaaagacagaagcccucacagaacauugaugaguuguccugugggugaggcucccucuccauacaacucaagguuugagucuguugcuuggucagcaagugcuugccaugauggcaccaguugguugacaauuggaauuucuggcccagacaauggggcuguggcuguguugaaauacaauggcauaauaacagacacuaucaagaguuggaggaacaacauacuaagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcucccaauuaucacuaugaggagugcuccuguuauccugaugcuggcgaaaucacaugugugugcagggauaauuggcauggcucaaacaggccauggguauccuucaaucaaaauuuggaguaucaaauaggauauauaugcaguggaguuuuuggagacaauccacgccccaaugauggaacagguaguugugguccgauguccucuaacggggcauaugggguaaagggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccaacauccagaacugacaggauuagauugcauaagaccuuguuucuggguugaguuaaucagagggcgacccaaagagagcacaauuuggacuagugggagcagcauaucuuuuugugguguaaauagugacacugugaguuggucuuggccagacggugcugaguugccauucaccauugacaaguaa

SEQ ID NO: 45904 - RNA, 1350 nt, Artificial Sequence; identical to SEQ ID NO: 45903
  neuraminidase__InfluenzaA__ABI36168

SEQ ID NO: 45905 - RNA, 1350 nt, Artificial Sequence; identical to SEQ ID NO: 45903
  neuraminidase__InfluenzaA__ABI36179

SEQ ID NO: 45906 - RNA, 1350 nt, Artificial Sequence; identical to SEQ ID NO: 45903
  neuraminidase__InfluenzaA__ABI36189

SEQ ID NO: 45907 - RNA, 1350 nt, Artificial Sequence
  neuraminidase__InfluenzaA__ABI36278
augaauccaaaucagaagauaauaaccauuggaucaaucuguaugguaauuggaauaguuagcuuaauguuacaaauugggaacaugaucucaauaugggucagucauucaauucagaaagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucauguucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggacuagauugcauaagaccuuguuucuggguugaguuaaucagagggcggcccaaagagagcacaauuuggacuagugggaguagcauaucuuuuugugguguaaauagugacacugugagcuggucuuggccagacggugcugaguugccauucaccauugacaaguag

SEQ ID NO: 45908 - RNA, 1350 nt, Artificial Sequence; identical to SEQ ID NO: 45907
  neuraminidase__InfluenzaA__ABI36287

SEQ ID NO: 45909 - RNA, 1350 nt, Artificial Sequence
  neuraminidase__InfluenzaA__ABI36298
augaauccaaaucagaagauaauaaccauuggaucaaucuguaugguaauuggaauaguuagcuuaauguuacaaauugggaacaugaucucaauaugggucagucauucaauucagaaagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacuuagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacagggcuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45910 - RNA, 1350 nt, Artificial Sequence
  neuraminidase__InfluenzaA__ABI36314
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaacaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcucuuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45911 - RNA, 1350 nt, Artificial Sequence
  neuraminidase__InfluenzaA__ABI36336
augaauccaaaucagaagauaauaaccauuggaucaaucuguaugguaauugggauaguuagcuuaauguuacaaauugggaacaugaucucaauaugggucagucauucaguucagacagggaaucaacaccaagcugaaucaaucagcaauacuaacccucuuacugagaaggcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuuuuugacucagggagccuugcugaaugacaagcacuccaacgggacugucaaagacagaagcccucacagaacauuaaugaguuguccuuugggugaggcucccucuccauauaacucaagguuugagucuguuucuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauauggaguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagaggacggcccaaagagagcacaauuuggacuagugggagcaucauaucuuuuugugguguaaauagugacacugugaguuggucuuggccagacggugcugaguugccauucaccauugacaaguag

SEQ ID NO: 45912 - RNA, 1350 nt, Artificial Sequence
  neuraminidase__InfluenzaA__ABI36358
augaauccaaaucagaagauaauaaccauuggaucaaucuguaugguaauuggaauaguuagcuuaauguuacaaauugggaacaugaucucaauaugggucagucauucaguucagacagggaaucaacaccaagcugaaucaaucagcaauacuaacccucuuacugagaaagcuguggcuucaguaacauuagcgggcaauucaucucuuugucccauuagaggaugggcuguacacaguaaggacaacaauauaaggaucgguuccaagggggauguguuuguuauuagagagccguucaucucaugcucccaccuggaaugcagaacuuucuuuuugacucagggagccuugcugaaugacaagcacuccaacgggacugucaaagacagaagcccucacagaacauuaaugaguuguccugugggugaggcucccucuccauauaacucaagauuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauauggaguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagaggacggcccaaagagagcacaauuuggacuagugggagcagcauaucuuuuugugguguaaauagugacacugugaguuggucuuggccagacggugcugaguugccauucaccauugacaaguag

SEQ ID NO: 45913 - RNA, 1350 nt, Artificial Sequence
  neuraminidase__InfluenzaA__ABI36369
augaauccaaaucagaagauaauaaccauuggaucaaucuguauggcaauuggaacaguuagcuuaauguuacaaauugggaacaugaucucaauaugggucagccauucaauucagacagggaaccaacaccaagcugaaucaaucagcaauacuaacccucuuacugagaaagcuguggcuucaguaacauuggcaggcaauucgucucuuugccccauuagaggaugggcuguacacaguaaggacaacaguauaaggaucgguuccaagggggauguguuuguuauuagagagccguucaucucaugcucccacucggaaugcagaacuuucuuuuugacucagggagcccugcugaaugacaagcacuccaacgagacugucaaagacagaagcccucacagaacauugaugaguuguccugugggugaggcucccucuccauacaacucaagguuugagucuguugcuuggucagcaagugcuugccaugauggcaccaguugguugacaauuggaauuucuggcccagacaauggggcuguggcuguguugaaauacaauggcauaauaacagacacuaucaagaguuggaggaacaacauacuaagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcucccaauuaucacuaugaggagugcuccuguuauccugaugcuggcgaaaucacaugugugugcagggauaauuggcauggcucaaacaggccauggguauccuucaaucaaaauuuggaguaucaaauaggauauauaugcaguggaguuuuuggagacaauccacgccccaaugauggaacagguaguugugguccgauguccucuaacggggcauaugggguaaagggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccaacauccagaacugacaggauuagauugcauaagaccuuguuucuggguugaguuaaucagagggcgacccaaagagagcacaauuuggacuagugggagcagcauaucuuuuugugguguaaacagugacacugugaguuggucuuggccagacggugcugaguugccauucaccauugacaaguaa

SEQ ID NO: 45914 - RNA, 1350 nt, Artificial Sequence
  neuraminidase__InfluenzaA__ABI36391
augaauccaaaucagaagauaauaaccauuggaucaaucuguaugguaauuggaauaguuagcuuaauguuacaaauugggaacaugaucucaauaugggucagucauucaacucagaaagggaaucaacaccaagcugaaucaaucagcaauacuaacccucuuacugagaaagcuguggcuucaguaacauuagcgggcaauucaucucuuugcccuauuagaggaugggcuguacacaguaaggacaacaauauaaggaucgguuccaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguaucuuucaaucaaaauuuggaguaucaaauaggauauauaugcaguggaauuuucggagacaauccacgccccaaugauggaacagguaguuguggcccgauguucccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggacuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45915 - RNA, 1350 nt, Artificial Sequence; identical to SEQ ID NO: 45914
  neuraminidase__InfluenzaA__ABI36402

SEQ ID NO: 45916 - RNA, 1350 nt, Artificial Sequence
  neuraminidase__InfluenzaA__ABI36413
augaauccaaaucagaagauaauaaccauuggaucaaucuguauggcaauuggaacaguuagcuuaauguuacaaauugggaacaugaucucaauaugggucagccauucaauucagacagggaaccaacaccaagcugaaucaaucagcaauacuaacccucuuacugagaaagcuguggcuucaguaacauuggcaggcaauucgucucuuugccccauuagaggaugggcuguacacaguaaggacaacaguauaaggaucgguuccaagggggauguguuuguuauuagagagccguucaucucaugcucccacucggaaugcagaacuuucuuuuugacucagggagcccugcugaaugacaagcacuccaacgagacugucaaagacagaagcccucacagaacauugaugaguuguccugugggugaggcucccucuccauacaacucaagguuugaaucuguugcuuggucagcaagugcuugccaugauggcaccaguugguugacaauuggaauuucuggcccagacaauggggcuguggcuguguugaaauacaauggcauaauaacagacacuaucaagaguuggaggaacaacauacuaagaacucaagagucugaaugugcauguguaaauggcucuugcuuuacuguaaugacugauggaccaaguaaugggcaggcaucauauaagaucuucaaaauggaaaaagggaaagugguuaaaucagucgaauuggaugcucccaauuaucacuaugaggagugcuccuguuauccugaugcuggcgaaaucacaugugugugcagggauaauuggcauggcucaaacaggccauggguauccuucaaucaaaauuuggaguaucaaauaggauauauaugcaguggaguuuuuggagacaauccacgccccaaugauggaacagguaguugugguccgauguccucuaacggggcauaugggguaaagggguuuucauuuaaauacggcaaugguguuuggaucgggagaaccaaaagcacuaauuccagaagcggcuuugaaaugauuugggauccaaauggguggacuggaacggacaguagcuuuucggugaaacaagauauaguagcaauaacugauuggucaggauauagugggaguuuuguccaacauccagaacugacaggauuagauugcauaagaccuuguuucuggguugaguuaaucagagggcgacccaaagagagcacaauuuggacuagugggagcagcauaucuuuuugugguguaaacagugacacugugaguuggucuuggccagacggugcugaguugccauucaccauugacaaguaa

SEQ ID NO: 45917 - RNA, 1350 nt, Artificial Sequence
  neuraminidase__InfluenzaA__ABI36446
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugaggacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggauaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45918 - RNA, 1350 nt, Artificial Sequence
  neuraminidase__InfluenzaA__ABI36457
augaauccaaaucagaagauaauaaccauuggaucaaucuguaugguaauuggaauaguuagcuuaauguuacaaauugggaacaugaucucaauaugggucagucauucaauucagaaagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaaugcagaacuuucuucuugacucagggagccuugcugaaugacaagcacuccaacgggacugucaaagacagaagcccucacagaacacuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggauaguagcuuuucagugaaacaagauauaguagcaauaacugauuggucaggauauagcgggaguuuuguccagcauccagaacugacaggacuagauugcauaagaccuuguuucuggguugaguuaaucagagggcggcccaaagagagcacaauuuggacuagugggagcagcauaucuuuuugugguguaaauagugacacugugagcuggucuuggccagacggugcugaguugccauucaccauugacaaguag

SEQ ID NO: 45919 - RNA, 1350 nt, Artificial Sequence
  neuraminidase__InfluenzaA__ABI36476
augaauccaaaucagaagauaauaaccauuggaucaaucuguaugguaauuggaauaguuagcuuaauguuacaaauugggaacaugaucucaauaugggucagucauucaacucagaaagggaaucaacaccaagcugaaucaaucagcaauacuaacccucuuacugagaaagcuguggcuucaguaacauuagcgggcaauucaucucuuugcccuauuagaggaugggcuguacacaguaaggacaacaauauaaggaucgguuccaagggggauguguuuguuauuagagagccguucaucucaugcucccaccuggaaugcagaacuuucuucuugacucagggagccuugcugaaugacaagcacuccaacggaacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggacuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 45920 - RNA, 1350 nt, Artificial Sequence
  neuraminidase__InfluenzaA__ABI49409
augaauccaaaucggaagauaauaaccauuggaucaaucuguaugguaauuggaaugguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggagccuugcugaaugacaagcacuccaacggaacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauccugagaacucaagagucugaaugugcauguguaaauggcucuugcuuuacuguaaugacugauggaccaaguaaugggcaggcaucauauaagaucuucaaaauggaaaaaggaaagguggucaaaucagucgaauugguugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacaggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugcgaguuggucuuggccagacggugcugaguugccauucaccauugacaaguag

SEQ ID NO: 45921 - RNA, 1350 nt, Artificial Sequence
  neuraminidase__InfluenzaA__ABI49417
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucggggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugaggacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcagcccaaagagagcacaauuuggacuagugggagcagcauaucuuuuugugguguaaauagugacacugugaguuggucuuggccagacggugcugaguugccauucaccauugacaaguag

SEQ ID NO: 45922 - RNA, 1410 nt, Artificial Sequence
  neuraminidase__InfluenzaA__ABI84962
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 45923 - RNA, 1410 nt, Artificial Sequence
  neuraminidase__InfluenzaA__ABI85003
augaauccgaaucagaagauaauaacaaucgggguagugaauaccacucugucaacaauagcccuucucauuggagugggaaacuuaguuuucaacacagucauacaugagaaaauaggagaccaucaaauagugacccauccaacaauaaugaccccugaaguaccgaacugcagugacacuauaauaacauacaauaacacuguuauaaacaacauaacaacaacaauaauaacugaagcagaaaggccuuucaagucuccacuaccgcugugccccuucagaggauucuucccuuuucacaaggacaaugcaauacgacugggugaaaacaaagacgucauagucacaagggagccuuauguuagcugcgauaaugacaacugcugguccuuugcucucgcacaaggagcauugcuagggacuaaacauagcaaugggaccauuaaagacagaacaccauauaggucucuaauucguuucccaauaggaacagcuccaguacuaggaaauuacaaagagauaugcauugcuuggucgagcagcaguugcuuugacgggaaagaguggaugcaugugugcaugacagggaaugauaaugaugcaagugcccagauaauauauggaggaagaaugacagacuccauuaaaucauggaggaaagacauacuaagaacccaggagucugaaugucaaugcauugacgggacuuguguuguugcugucacagauggcccugcugcuaauagugcagaucacaggguuuacuggauacgggagggaagaauaauaaaguaugaaaauguucccaaaacaaagauacaacacuuagaagaauguuccugcuauguggacauugauguuuacuguauauguagggacaauuggaagggcucuaacagaccuuggaugagaaucaacaacgagacuauacuggaaacaggauauguauguaguaaauuucacucagacacccccaggccagcugacccuucaauaaugucaugugacuccccaagcaaugucaauggaggacccggagugaagggguuugguuucaaagcuggcaaugauguaugguuagguagaacagugucaacuagugguagaucgggcuuugaaauuaucaaaguuacagaaggguggaucaacucuccuaaccaugucaaaucaauuacacaaacacuaguguccaacaaugacuggucaggcuauucagguagcuucauugucaaagccaaggacuguuuucagcccuguuuuuauguugagcuuauacgagggaggcccaacaagaaugaugacgucucuuggacaaguaauaguauaguuacuuucuguggacuagacaaugaaccuggaucgggaaauuggccagaugguucuaacauuggguuuaugcccaaguaa

SEQ ID NO: 45924 - RNA, 1410 nt, Artificial Sequence; identical to SEQ ID NO: 45594
  neuraminidase__InfluenzaA__ABI92294

SEQ ID NO: 45925 - RNA, 1413 nt, Artificial Sequence
  neuraminidase__InfluenzaA__ABI92305
augaauccaaaucagaaaauaauaaccauuggaucaaucuguauggcaaucgggauaauuagucuaauauugcaaauaggaaauauuauuucaauauggguuagccacuuaauccaaacuggaagucaaaaccacacuggaauaugcaaccaaagaaucaucaccuaugaaaauagcaccuggguaaaucaaacauauguuaauauuaacaacacuaacguuguugcuggaaaggacacaacuucagugacacuagccggcaauucaucucuuuguccuguccgugggugggcuauauacagcaaagacaacagcauaagaauugguuccaaaggagauguuuuugucauaagagaaccuuuuauaucauguucucacuuggaaugcagaaccuuuuuucuaacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucuggaccagaugauggagcaguggcuguacuaaaauacaacggcauaauaacugaaaccauaaaaaguuggaggaaacgaauauuaagaacacaagagucugaaugugucuguauaaacgguucauguuuuaccauaaugaccgauggcccaaguaaugggccggccucguacagaaucuucaaaaucgagaaggggaaaauuacuaaaucaauagaguuggaugcacccaauucucacuacgaggaauguuccuguuacccagacaccggcacagugaugugugugugcagagacaauuggcaugguucgaaucgaccuuggguguccuuuaaucaaaaccuggauuaucaaauaggauacaucugcagugggguuuucggugacaacccgcgucccaaagauggaaaaggcagcugugguccaguaacuguugauggagcagacggaguaaagggguuuucauacagguaugguaauggugucuggauaggaagaacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacuguaaauuggucuuggccagacggugccgaguugccauucaccauugacaaguag

SEQ ID NO: 45926 - RNA, 1413 nt, Artificial Sequence
  neuraminidase__InfluenzaA__ABI92316
augaauccaaaucaaaaaauaauaaccauuggaucaaucaguauugcaauuggaguaauuagucugauauugcaaauaggaaauauuauuucaauaugggcuagccacucaauccaaacuggaagucaaaaccacacuggaauaugcaaccaaaggaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucugugugaacgguucauguuuuaccauaaugaccgauggcccgaguaauggggccgcaucguacagaaucuucaaaaucgagaaggguagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 45927 - RNA, 1410 nt, Artificial Sequence
  neuraminidase__InfluenzaA__ABI92327
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacaguuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguaucguuguguuuuguggcaccucagguacauauggaacaggcucauggccugauggggcggacaucaaucucaugccuauauaa

SEQ ID NO: 45928 - RNA, 1410 nt, Artificial Sequence
  neuraminidase__InfluenzaA__ABI92338
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccagcaauaauagaaagaaacauaacagagauaguguaucugaccaacaccaccauagagaaggaaauaugccccaaauuagcagaauacagaaauuggucaaagccgcaauguaacauuacaggauuugcaccuuuuuccaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguuaauauuagcacauugucaggaagugcucagcaugucgaggagugcuccuguuauccucgauauccuggugucagaugugucugcagagacaacuggaaaggcuccaauaggcccaucauagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaaguuugguggaccucaaacaguauuguuguguuuuguggcaccucagguacauauggaacaggcucauggccugauggggcggauaucaaucucaugccuauauaa

SEQ ID NO: 45929 - RNA, 1410 nt, Artificial Sequence
  neuraminidase__InfluenzaA__ABI92349
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcaaaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguuuggauaggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45930 - RNA, 1410 nt, Artificial Sequence
  neuraminidase__InfluenzaA__ABI92360
augaauccaaaucaaaagauaauaacgauuggcucuguuucucucaccauuuccacaauaugcuucuuuaugcaaauugccaucuugauaacaacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45931 - RNA, 1410 nt, Artificial Sequence; identical to SEQ ID NO: 44870
  neuraminidase__InfluenzaA__ABI92371

SEQ ID NO: 45932 - RNA, 1413 nt, Artificial Sequence; identical to SEQ ID NO: 45834
  neuraminidase__InfluenzaA__ABI92382

SEQ ID NO: 45933 - RNA, 1410 nt, Artificial Sequence; identical to SEQ ID NO: 45886
  neuraminidase__InfluenzaA__ABI92393

SEQ ID NO: 45934 - RNA, 1410 nt, Artificial Sequence
  neuraminidase__InfluenzaA__ABI92404
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaaguuauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45935 - RNA, 1410 nt, Artificial Sequence
  neuraminidase__InfluenzaA__ABI92415
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaauuucaugccuauauga

SEQ ID NO: 45936 - RNA, 1410 nt, Artificial Sequence; identical to SEQ ID NO: 45893
  neuraminidase__InfluenzaA__ABI92426

SEQ ID NO: 45937 - RNA, 1410 nt, Artificial Sequence; identical to SEQ ID NO: 45893
  neuraminidase__InfluenzaA__ABI92437

SEQ ID NO: 45938 - RNA, 1410 nt, Artificial Sequence
  neuraminidase__InfluenzaA__ABI92448
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45939 - RNA, 1410 nt, Artificial Sequence; identical to SEQ ID NO: 45893
  neuraminidase__InfluenzaA__ABI92459

SEQ ID NO: 45940 - RNA, 1410 nt, Artificial Sequence
  neuraminidase__InfluenzaA__ABI92470
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucagaaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45941 - RNA, 1410 nt, Artificial Sequence; identical to SEQ ID NO: 45247
  neuraminidase__InfluenzaA__ABI92481

SEQ ID NO: 45942 - RNA, 1410 nt, Artificial Sequence; identical to SEQ ID NO: 45247
  neuraminidase__InfluenzaA__ABI92492

SEQ ID NO: 45943 - RNA, 1410 nt, Artificial Sequence
  neuraminidase__InfluenzaA__ABI92503
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagaagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugagagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45944 - RNA, 1410 nt, Artificial Sequence
  neuraminidase__InfluenzaA__ABI92514
augaauccaaaucaaaagauaauaacgauuggcucuguuucucucacuauugccacaauaugcuuccuugugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacuggggaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguacauacuagcaaacugucaggaagugcucagcaugucgaggagugcuccuguuauccucgauauccuggugucagaugugucuguagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggagaugauguguggaugggaagaacgaucagcgagaagucacgcucugguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaccggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45945 - RNA, 1410 nt, Artificial Sequence
  neuraminidase__InfluenzaA__ABI92525
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugcccuaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaguuggguguuccauuucauuugggaaccaagcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45946 - RNA, 1410 nt, Artificial Sequence
  neuraminidase__InfluenzaA__ABI92536
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaaagugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggagcaggcucauggccugauggggcggauaucaaucucaugccuauauaa

SEQ ID NO: 45947 - RNA, 1410 nt, Artificial Sequence
  neuraminidase__InfluenzaA__ABI92547
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaaugugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggagcaggcucauggccugauggggcggauaucaaucucaugccuauauaa

SEQ ID NO: 45948 - RNA, 1410 nt, Artificial Sequence
  neuraminidase__InfluenzaA__ABI92558
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaggccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaagauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaacccaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacagcauuguuguguuuuguggcaccucagguacauauggaacaggcucauggccugauggggcggauaucaaucucaugccuauauaa

SEQ ID NO: 45949 - RNA, 1410 nt, Artificial Sequence
  neuraminidase__InfluenzaA__ABI92569
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugagccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaagcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaauugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45950 - RNA, 1410 nt, Artificial Sequence
  neuraminidase__InfluenzaA__ABI92580
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaacaaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauauuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucauugaaggcugguccaaaccuaacuccaaauuacagauaaauaggcaagucauaguugaaagagguaacagguccgguuauucugguauuuucuccguugaaggcaaaggcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45951 - RNA, 1410 nt, Artificial Sequence
  neuraminidase__InfluenzaA__ABI92591
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccacaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugagaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauauuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagccucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucauugaaggcugguccaaaccuaacuccaaauuacagauaaauaggcaagucauaguugaaagagguaacagguccgguuauucugguauuuucuccguugaaggcaaaggcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45952 - RNA, 1410 nt, Artificial Sequence
  neuraminidase__InfluenzaA__ABI92602
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuuaauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaagauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagguaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggauaucaaucucaugccuauauaa

SEQ ID NO: 45953 - RNA, 1410 nt, Artificial Sequence
  neuraminidase__InfluenzaA__ABI92613
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggauaaugaaaaugcaacugcuagcuucauuuacaaugggaagcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaauugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45954 - RNA, 1410 nt, Artificial Sequence
  neuraminidase__InfluenzaA__ABI92624
augaauccaaaucaaaagauaauaacaauuggcucuguuucccucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugauaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45955 - RNA, 1410 nt, Artificial Sequence
  neuraminidase__InfluenzaA__ABI92635
augaauccaaaucaaaagauaauaacaauuggcucuguuucucucaccauugccacaauaugcuuccuuaugcaaauugccauccugguaacuacuguaacauugcauuucaagcaguaugaaugcaacccccccccaaacaaccaaguaaugcuaugugaaccaacaauaauagaaagaaacauaacagagauaguguaucugaccaacacuaccauagagaaggaaauaugccccaaauuagcagaauacagaaauuggucaaagccgcaauguaaccuuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauugggugucccauuccauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauaauauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45956 - RNA, 1410 nt, Artificial Sequence
  neuraminidase__InfluenzaA__ABI92646
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguauaaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45957 - RNA, 1410 nt, Artificial Sequence
  neuraminidase__InfluenzaA__ABI92657
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguauaaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucgguguuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45958 - RNA, 1410 nt, Artificial Sequence
  neuraminidase__InfluenzaA__ABI92668
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgguccugauaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguauaaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45959 - RNA, 1410 nt, Artificial Sequence; identical to SEQ ID NO: 45095
  neuraminidase__InfluenzaA__ABI92679

SEQ ID NO: 45960 - RNA, 1410 nt, Artificial Sequence; identical to SEQ ID NO: 45957
  neuraminidase__InfluenzaA__ABI92701

SEQ ID NO: 45961 - RNA, 1410 nt, Artificial Sequence
  neuraminidase__InfluenzaA__ABI92712
augaauccaaaucaaaagauaauaacaauuggcucuguuucucucaccauugccacaauaugcuuccuuaugcaaauugccauccugguaacuacuguaacauugcauuucaagcagcacgaaugcaacucccccccaaacaaccaagcaaugcugugugaaccaacaacaacagaaagaaacacaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45962 - RNA, 1410 nt, Artificial Sequence
  neuraminidase__InfluenzaA__ABI92723
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaagcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 45963 - RNA, 1410 nt, Artificial Sequence; identical to SEQ ID NO: 45956
  neuraminidase__InfluenzaA__ABI92734

SEQ ID NO: 45964 - RNA, 1410 nt, Artificial Sequence; identical to SEQ ID NO: 45095
  neuraminidase__InfluenzaA__ABI92745

SEQ ID NO: 45965 - RNA, 1410 nt, Artificial Sequence
  neuraminidase__InfluenzaA__ABI92756
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaauacugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaagcugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaauguguuuguauaaauggaacuuguacaguaguaaugacugaugggagcgcuucaggaaaagcugauacuaaaauacuauucauugaggaggggaaaaucguucauauuagcacauugucaggaagugcucagcauguugaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggacaucaaucucaugccuauauaa

SEQ ID NO: 45966 - RNA, 1410 nt, Artificial Sequence
  neuraminidase__InfluenzaA__ABI92767
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguauaaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagagaaaacugaagucugguggaccucaaacaguauuguuguguuuuguggcaccucagguacauauggaacaggcucauggccugauggggcggacaucaaucucaugccuauauaa

SEQ ID NO: 45967 - RNA, 1410 nt, Artificial Sequence; identical to SEQ ID NO: 45957
  neuraminidase__InfluenzaA__ABI92778

SEQ ID NO: 45968 - RNA, 1410 nt, Artificial Sequence
  neuraminidase__InfluenzaA__ABI92789
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagauaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45969 - RNA, 1410 nt, Artificial Sequence; identical to SEQ ID NO: 44870
  neuraminidase__InfluenzaA__ABI92800

SEQ ID NO: 45970 - RNA, 1410 nt, Artificial Sequence
  neuraminidase__InfluenzaA__ABI92811
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugccccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagauaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45971 - RNA, 1410 nt, Artificial Sequence
  neuraminidase__InfluenzaA__ABI92822
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaaugacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45972 - RNA, 1410 nt, Artificial Sequence; identical to SEQ ID NO: 45968
  neuraminidase__InfluenzaA__ABI92844

SEQ ID NO: 45973 - RNA, 1410 nt, Artificial Sequence; identical to SEQ ID NO: 45968
  neuraminidase__InfluenzaA__ABI92855

SEQ ID NO: 45974 - RNA, 1410 nt, Artificial Sequence
  neuraminidase__InfluenzaA__ABI92866
augaauccaaaucaaaagauaauaacaauuggcucugcuucucucaccauugccacaauaugcuuccuuauucaaauugcaauccugguaacuacuguaacauugcauuucaagcagcaugaaugcaacucccucccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaccaauuugcccuugggcagggaacaacacuaaacaacgggcauucaaaugacacaguacaugauaggaccccuuaccggaccuuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauuaguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagaugugucugcagagacaauuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaauccuaauuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggauaucaaucucaugccuauauaa

SEQ ID NO: 45975 - RNA, 1410 nt, Artificial Sequence; identical to SEQ ID NO: 45970
  neuraminidase__InfluenzaA__ABI92877

SEQ ID NO: 45976 - RNA, 1410 nt, Artificial Sequence; identical to SEQ ID NO: 45970
  neuraminidase__InfluenzaA__ABI92888

SEQ ID NO: 45977 - RNA, 1410 nt, Artificial Sequence
  neuraminidase__InfluenzaA__ABI92899
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45978 - RNA, 1410 nt, Artificial Sequence; identical to SEQ ID NO: 45977
  neuraminidase__InfluenzaA__ABI92910

SEQ ID NO: 45979 - RNA, 1410 nt, Artificial Sequence; identical to SEQ ID NO: 44870
  neuraminidase__InfluenzaA__ABI92921

SEQ ID NO: 45980 - RNA, 1410 nt, Artificial Sequence; identical to SEQ ID NO: 45977
  neuraminidase__InfluenzaA__ABI92932

SEQ ID NO: 45981 - RNA, 1410 nt, Artificial Sequence
  neuraminidase__InfluenzaA__ABI92943
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaacauucaaagucauugaaggcugguccaauccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45982 - RNA, 1410 nt, Artificial Sequence; identical to SEQ ID NO: 45218
  neuraminidase__InfluenzaA__ABI92954

SEQ ID NO: 45983 - RNA, 1410 nt, Artificial Sequence
  neuraminidase__InfluenzaA__ABI92965
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgaccgcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45984 - RNA, 1410 nt, Artificial Sequence; identical to SEQ ID NO: 45218
  neuraminidase__InfluenzaA__ABI92976

SEQ ID NO: 45985 - RNA, 1410 nt, Artificial Sequence; identical to SEQ ID NO: 45218
  neuraminidase__InfluenzaA__ABI92987

SEQ ID NO: 45986 - RNA, 1410 nt, Artificial Sequence; identical to SEQ ID NO: 45218
  neuraminidase__InfluenzaA__ABI92998

SEQ ID NO: 45987 - RNA, 1410 nt, Artificial Sequence
  neuraminidase__InfluenzaA__ABI93009
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacgagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaagcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 45988 - RNA, 1410 nt, Artificial Sequence; identical to SEQ ID NO: 45218
  neuraminidase__InfluenzaA__ABI93020

SEQ ID NO: 45989 - RNA, 1413 nt, Artificial Sequence; identical to SEQ ID NO: 45860
  neuraminidase__InfluenzaA__ABI93031

SEQ ID NO: 45990 - RNA, 1410 nt, Artificial Sequence; identical to SEQ ID NO: 45615
  neuraminidase__InfluenzaA__ABI93042

SEQ ID NO: 45991 - RNA, 1410 nt, Artificial Sequence
  neuraminidase__InfluenzaA__ABI93053
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaaggaggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 45992 - RNA, 1410 nt, Artificial Sequence
  neuraminidase__InfluenzaA__ABI93064
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauauagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaccgaacccuauugaugaaugaguuggguguuccauuucauuugggaaccaagcaaguaugcauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauaccaaaauacuauucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauagguccgguuauucugguauuuucucuguugaaggcaaaagcugcaucaaucggugcuuuuauguggaguugauaaggggaaggaaacaggaaacugaagucugguggaccucaaacaguauuguuguguucuguggcaccucagguacauauggaacaggcucauggccugauggggcggacaucaaucucaugccuauauaa

SEQ ID NO: 45993 - RNA, 1410 nt, Artificial Sequence
  neuraminidase__InfluenzaA__ABI93075
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucuggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45994 - RNA, 1410 nt, Artificial Sequence; identical to SEQ ID NO: 45247
  neuraminidase__InfluenzaA__ABI93086

SEQ ID NO: 45995 - RNA, 1410 nt, Artificial Sequence; identical to SEQ ID NO: 45247
  neuraminidase__InfluenzaA__ABI93097

SEQ ID NO: 45996 - RNA, 1410 nt, Artificial Sequence
  neuraminidase__InfluenzaA__ABI93108
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaugauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45997 - RNA, 1410 nt, Artificial Sequence
  neuraminidase__InfluenzaA__ABI93119
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacaacuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagaaguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 45998 - RNA, 1416 nt, Artificial Sequence
  neuraminidase__InfluenzaA__ABI94584
augaauccaaaucagaaacuauuugcauuaucuggaguggcaauagcacuuaguguacugaacuuauugauaggaaucucaaacgucggauugaacguaucucuacaucuaaaggaaaaaggacccaaacaggaggagaauuuaacaugcacgaccauuaaucaaaacaacacuacuguaguagaaaacacauauguaaauaauacaacaauaauuaccaagggaacugauuugaaaacaccaagcuaucugcuguugaacaagagccugugcaauguugaagggugggucgugauagcaaaagacaaugcaguaagauuuggggaaagugaacaaaucauuguuaccagggagccauauguaucaugcgacccaacaggaugcaaaauguaugccuugcaccaagggacuaccauuaggaacaaacauucaaauggaacgauucaugacagaacagcuuucagaggucucaucuccacuccauugggcacuccaccaaccguaaguaacagugacuuuauguguguuggauggucaagcacaacuugccaugaugggauugcuaggaugacuaucuguauacaaggaaauaaugacaaugcuacagcaacgguuuauuacaacagaaggcugaccacuaccauuaagaccugggccagaaacauucugaggacucaagaaucagaaugugugugccacaauggcacaugugcaguuguaaugaccgacggaucggcuaguagucaagccuauacaaaaguaauguauuuccacaagggauuaguaguuaaggaggaggaguuaaggggaucagccagacauauugaggaaugcuccuguuauggacacaaucaaaaggugaccugugugugcagagauaacuggcagggagcaaacaggccuauuauagaaauugauaugagcacauuggagcacacaaguagauacgugugcacuggaauucucacagacaccagcagaccuggggacaaaucuaguggugauuguuccaauccaauaacugggagucccggcguuccgggagugaagggauucggguuucuaaauggggauaacacauggcuugguaggaccaucagccccagaucaagaaguggauucgaaauguugaaaauaccuaaugcagguacugaucccaauucuagaauagcagaacgacaggaaauugucgacaauaacaauuggucaggcuauuccggaagcuuuauugacuauuggaaugauaacagugaaugcuacaauccaugcuuuuacguagaguuaauuagaggaagacccgaagaggcuaaauacguauggugggcaaguaacagucuaauugcccuauguggaagcccauucccaguugggucugguuccuuccccgauggggcacaaauccaauacuuuucguaa

SEQ ID NO: 45999 - RNA, 1413 nt, Artificial Sequence
  neuraminidase__InfluenzaA__ABI95220
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguuuucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46000 - RNA, 1410 nt, Artificial Sequence
  neuraminidase__InfluenzaA__ABI95242
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugguaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46001 - RNA, 1413 nt, Artificial Sequence
  neuraminidase__InfluenzaA__ABI95253
augaauccaaaucaaaaaauaauaaccauuggaucaaucaguauagcaaucggaauaauuaguauaauguugcaaauagggaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauauaauucaaaguuugaaucaguugcuuggucagcaagcgcaugccaugauggcaugggcugguuaacaaucggaauuucugguccagauaauggagcaguggcuguacuaaaauacaacggcauaaucacugaaaccauaaaaaguuggaaaaagcgaauauuaagaacacaagagucugaaugugucugugugaacgggucauguuuuaccauaaugaccgauggcccgagugauggggccgccucguacaaaaucuucaagaucgaaaaggggaagguuacuaaaucaauagaguugaaugcacccaauucucauuaugaggaauguuccuguuacccagacacuggcacagugauguguguaugcagggacaacuggcacgguucaaaucgaccuugggugucuuuuaaucaaaaccuggauuaucaaauaggauacaucugcagugggguguucggugacaacccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 46002 - RNA, 1413 nt, Artificial Sequence; identical to SEQ ID NO: 45860
  neuraminidase__InfluenzaA__ABI95264

SEQ ID NO: 46003 - RNA, 1413 nt, Artificial Sequence; identical to SEQ ID NO: 45860
  neuraminidase__InfluenzaA__ABI95275

SEQ ID NO: 46004 - RNA, 1413 nt, Artificial Sequence; identical to SEQ ID NO: 45860
  neuraminidase__InfluenzaA__ABI95286

SEQ ID NO: 46005 - RNA, 1413 nt, Artificial Sequence
  neuraminidase__InfluenzaA__ABI95297
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaagaacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauagugauacugcaaacuggucuuggccagacggugcugaguugccguucaccauugacaaguag

SEQ ID NO: 46006 - RNA, 1410 nt, Artificial Sequence
  neuraminidase__InfluenzaA__ABI95308
augaauccaaaucaaaagauaauaacgauuggcucuguuucucucacaauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaagaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46007 - RNA, 1413 nt, Artificial Sequence
  neuraminidase__InfluenzaA__ABI96131
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcugcaauccagugacuguugauggagcagacggaguuaagggguuuucauacaaauaugguaaugguguuuggauaggaaggacuaaaaguaacagacuuagaaaggguuuugagaugauuugggauccuaauggguggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46008 - RNA, 1413 nt, Artificial Sequence
  neuraminidase__InfluenzaA__ABI96133
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggguggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46009 - RNA, 1413 nt, Artificial Sequence
  neuraminidase__InfluenzaA__ABI96136
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaauggaauaauaacugaaaccauaaaaaguuggaaaaagcgaauauugagaacacaagagucugaaugugucugugugaacgggucauguuucaccauaaugaccgauggcccaaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggauuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46010 - RNA, 1410 nt, Artificial Sequence
  neuraminidase__InfluenzaA__ABJ09110
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucauucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcagcagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggagcggacaucaaucucaugccuauauaa

SEQ ID NO: 46011 - RNA, 1410 nt, Artificial Sequence
  neuraminidase__InfluenzaA__ABJ09143
augaauccaaaucaaaagauaauaacaauuggcucuguuucucucacuauugccacaauaugcuuccuuaugcaaauugccauccugguaacuacuguaacauugcauuucaagcaauaugagugcaacucccccccaagcaaccaaguaaugcugugugaaccaacaauaauagaaagaaacauaacagagauaguguauuugacuaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauuuauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaagguugggccuuugaugauggaaaugacguguggaugggaagaacgaucagcgaggaguuacgcucugguuaugaaaccuucaaaguuauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 46012 - RNA, 1413 nt, Artificial Sequence; identical to SEQ ID NO: 45429
  neuraminidase__InfluenzaA__ABJ09154

SEQ ID NO: 46013 - RNA, 1410 nt, Artificial Sequence; identical to SEQ ID NO: 44870
  neuraminidase__InfluenzaA__ABJ09165

SEQ ID NO: 46014 - RNA, 1410 nt, Artificial Sequence; identical to SEQ ID NO: 44870
  neuraminidase__InfluenzaA__ABJ09176

SEQ ID NO: 46015 - RNA, 1410 nt, Artificial Sequence; identical to SEQ ID NO: 45893
  neuraminidase__InfluenzaA__ABJ09198

SEQ ID NO: 46016 - RNA, 1410 nt, Artificial Sequence
  neuraminidase__InfluenzaA__ABJ09209
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccacaaugugacauuacaggauuugcaccuuuuucuaaggacaauucgauuaggcuuuccgcugguggggacaucugggugacaagagaaccuuaugugucaugcgacccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46017 - RNA, 1410 nt, Artificial Sequence
  neuraminidase__InfluenzaA__ABJ09220
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuagcaaaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacggggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgguauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 46018 - RNA, 1410 nt, Artificial Sequence; identical to SEQ ID NO: 45247
  neuraminidase__InfluenzaA__ABJ09231

SEQ ID NO: 46019 - RNA, 1410 nt, Artificial Sequence; identical to SEQ ID NO: 45247
  neuraminidase__InfluenzaA__ABJ09242

SEQ ID NO: 46020 - RNA, 1410 nt, Artificial Sequence; identical to SEQ ID NO: 45991
  neuraminidase__InfluenzaA__ABJ09253

SEQ ID NO: 46021 - RNA, 1410 nt, Artificial Sequence
  neuraminidase__InfluenzaA__ABJ09264
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguauaugaccaacaccaccauagagaaggaaauaugccccaaacuagcagaauacagaaauuggucaaagccgcaauguaacauuacaggauuugcaccuuuuucuaaggacaauucaauucggcuuuccgcugguggggacauuugggugacaagagagccuuauguaucaugcgauccugacaaguguuaucaauuugcccuuggacagggaacaacacuaaacaacaggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauauuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccugaauccuaacaaugaggaagguggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauaguuccgguuauucugguauuuucuccguugaaggcaaaagcugcaucaaucggugcuuuuauguggaguugauaaggggaaggaaacaggaaacugaagucugguggaccucaaacaguauuguugugcuuuguggcaccucagguacauauggaacaggcucauggccugauggggcggacaucaaucucaugccuauauaa

SEQ ID NO: 46022 - RNA, 1410 nt, Artificial Sequence
  neuraminidase__InfluenzaA__ABJ09286
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaagcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46023 - RNA, 1410 nt, Artificial Sequence
  neuraminidase__InfluenzaA__ABJ09308
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauacuagcaaauugucaggaagugcucagcacgucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaaggaggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 46024 - RNA, 1410 nt, Artificial Sequence; identical to SEQ ID NO: 45992
  neuraminidase__InfluenzaA__ABJ09319

SEQ ID NO: 46025 - RNA, 1413 nt, Artificial Sequence
  neuraminidase__InfluenzaA__ABJ09330
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggccuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuaauaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccccgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46026 - RNA, 1410 nt, Artificial Sequence
  neuraminidase__InfluenzaA__ABJ09341
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauuguuaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46027 - RNA, 1410 nt, Artificial Sequence
  neuraminidase__InfluenzaA__ABJ09352
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugguaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46028 - RNA, 1407 nt, Artificial Sequence
  neuraminidase__InfluenzaA__ABJ09374
augauccaaucaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuacgugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaagauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaaaaaaagaggaaacugaagucuuguggaccucaaacaguauuguuguguuuuguggcaccucagguacauauggaacaggcucauggccugauggggcggacaucaaucucaugccuauauaa

SEQ ID NO: 46029 - RNA, 1410 nt, Artificial Sequence; identical to SEQ ID NO: 46016
  neuraminidase__InfluenzaA__ABJ09385

SEQ ID NO: 46030 - RNA, 1410 nt, Artificial Sequence
  neuraminidase__InfluenzaA__ABJ16590
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46031 - RNA, 1410 nt, Artificial Sequence; identical to SEQ ID NO: 46022
  neuraminidase__InfluenzaA__ABJ16601

SEQ ID NO: 46032 - RNA, 1413 nt, Artificial Sequence
  neuraminidase__InfluenzaA__ABJ16612
augaauccaaaucaaaaaauaauaaccauuggaucaaucaguauagcaaucggaauaauuaguuuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacagucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46033 - RNA, 1410 nt, Artificial Sequence
  neuraminidase__InfluenzaA__ABJ16623
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccaguucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucacacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaagcaagucauaguugacagagguaauagguccgguuauucugguauuuucucuguugaaggcaaaagcugcaucaaucgaugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46034 - RNA, 1410 nt, Artificial Sequence
  neuraminidase__InfluenzaA__ABJ16634
augaauccaaaucaaaagauaauaacgauuggcucaguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaucaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcauguugaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46035 - RNA, 1413 nt, Artificial Sequence
  neuraminidase__InfluenzaA__ABJ16656
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46036 - RNA, 1413 nt, Artificial Sequence
  neuraminidase__InfluenzaA__ABJ16667
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcagugggguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46037 - RNA, 1413 nt, Artificial Sequence
  neuraminidase__InfluenzaA__ABJ16678
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucuuagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46038 - RNA, 1413 nt, Artificial Sequence
  neuraminidase__InfluenzaA__ABJ16689
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccaaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46039 - RNA, 1410 nt, Artificial Sequence
  neuraminidase__InfluenzaA__ABJ16700
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaagaaacaggaaacugaagucuuguggaccucaaacaguauuguuguguuuuguggcaccucagguacauauggaacaggcucauggccugauggggcggacaucaaucucaugccuauauaa

SEQ ID NO: 46040 - RNA, 1410 nt, Artificial Sequence
  neuraminidase__InfluenzaA__ABJ16711
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccaguucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauucuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacgcguggaugggaagaacgaucagcgagaaguuacgcucaggauaugaaaccuucaaagucauugaaggcugguccaaaucuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46041 - RNA, 1413 nt, Artificial Sequence
  neuraminidase__InfluenzaA__ABJ16733
augaauccaaaucaaaaaauaauaaccauuggaucaaucaguguggcaaucggaauaauuaaucuaauauugcaaauaggaaauauuauuucaauaugggcuagccacucaauccaaacuggaagucaaaacuacacuggaauaugcaaccaaagaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauauuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacacccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46042 - RNA, 1410 nt, Artificial Sequence; identical to SEQ ID NO: 45247
  neuraminidase__InfluenzaA__ABJ16744

SEQ ID NO: 46043 - RNA, 1410 nt, Artificial Sequence
  neuraminidase__InfluenzaA__ABJ16755
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccaguucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46044 - RNA, 1410 nt, Artificial Sequence
  neuraminidase__InfluenzaA__ABJ16766
augaauccaaaucaaaagauaauaacgauuggcucuguuucucucacuauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46045 - RNA, 1410 nt, Artificial Sequence
  neuraminidase__InfluenzaA__ABJ16777
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccaguucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauucuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46046 - RNA, 1410 nt, Artificial Sequence; identical to SEQ ID NO: 46043
  neuraminidase__InfluenzaA__ABJ16788

SEQ ID NO: 46047 - RNA, 1413 nt, Artificial Sequence
  neuraminidase__InfluenzaA__ABJ53441
augaauccaaaccaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucaugcucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuaugaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46048 - RNA, 1413 nt, Artificial Sequence
  neuraminidase__InfluenzaA__ABJ53452
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuauugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46049 - RNA, 1410 nt, Artificial Sequence; identical to SEQ ID NO: 45232
  neuraminidase__InfluenzaA__ABJ53463

SEQ ID NO: 46050 - RNA, 1410 nt, Artificial Sequence; identical to SEQ ID NO: 45232
  neuraminidase__InfluenzaA__ABJ53474

SEQ ID NO: 46051 - RNA, 1410 nt, Artificial Sequence
  neuraminidase__InfluenzaA__ABJ53485
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacucuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46052 - RNA, 1413 nt, Artificial Sequence; identical to SEQ ID NO: 45860
  neuraminidase__InfluenzaA__ABJ53496

SEQ ID NO: 46053 - RNA, 1413 nt, Artificial Sequence; identical to SEQ ID NO: 45860
  neuraminidase__InfluenzaA__ABJ53507

SEQ ID NO: 46054 - RNA, 1413 nt, Artificial Sequence
  neuraminidase__InfluenzaA__ABJ53518
augaauccaaaucaaaaaauaauaaccauuggaucaaucaguguggcaaucggaauaauuaaucuaauauugcaaauaggaaauauuauuucaauaugggcuagccacucaauccaaacuggaagucaaaacuacacuggaauaugcaaccaaagaaucauuacauaugaaaauagaaccuggguaaaucaaacauauguuaauauuaacaacacuaauguuguugcuggaaaggacaaaaccucgaugacauuggccggcaauuuaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46055 - RNA, 1410 nt, Artificial Sequence
  neuraminidase__InfluenzaA__ABK39965
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaauaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaacgaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaagauuauagcauuguuuccaguuaugugugcucaggacuuguuggagacacacccagaaaaaaugacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46056 - RNA, 1410 nt, Artificial Sequence
  neuraminidase__InfluenzaA__ABK39976
augaauccaaaucaaaagauaauaacgauuggcucuguuucucucaccauuuccacaacaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuugugcaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46057 - RNA, 1410 nt, Artificial Sequence
  neuraminidase__InfluenzaA__ABK39987
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggcaccucagguacauauggaacaggcucauggccugauggggcggacaucaaucucaugccuauauaa

SEQ ID NO: 46058 - RNA, 1410 nt, Artificial Sequence
  neuraminidase__InfluenzaA__ABK39998
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacaaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 46059 - RNA, 1410 nt, Artificial Sequence
  neuraminidase__InfluenzaA__ABK40020
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggagaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugauguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46060 - RNA, 1413 nt, Artificial Sequence
  neuraminidase__InfluenzaA__ABK40031
augaauccaaaucaaaaaauaauaaccauuggaucaaucaguguggcaaucggaauaauuaaucuaauauugcaaauaggaaauauuauuucaauaugggcuagccacucaauccaaacuggaagucaaaacuacacuggaauaugcaaccaaagaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46061 - RNA, 1413 nt, Artificial Sequence; identical to SEQ ID NO: 46060
  neuraminidase__InfluenzaA__ABK40042

SEQ ID NO: 46062 - RNA, 1413 nt, Artificial Sequence
  neuraminidase__InfluenzaA__ABK40053
augaauccaaaucaaaaaauaauaaccauuggaucaaucaguguggcaaucggaauaauuaaucuaauauugcaaauaggaaauauuauuucaauaugggcuagccacucaauccaaacuggaagucaaaacuacacuggaauaugcaaccaaagaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacacccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46063 - RNA, 1410 nt, Artificial Sequence; identical to SEQ ID NO: 46043
  neuraminidase__InfluenzaA__ABK40064

SEQ ID NO: 46064 - RNA, 1410 nt, Artificial Sequence; identical to SEQ ID NO: 46043
  neuraminidase__InfluenzaA__ABK40078

SEQ ID NO: 46065 - RNA, 1413 nt, Artificial Sequence; identical to SEQ ID NO: 45563
  neuraminidase__InfluenzaA__ABK40513

SEQ ID NO: 46066 - RNA, 1413 nt, Artificial Sequence; identical to SEQ ID NO: 45563
  neuraminidase__InfluenzaA__ABK40538

SEQ ID NO: 46067 - RNA, 1413 nt, Artificial Sequence
  neuraminidase__InfluenzaA__ABK40549
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuauaaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 46068 - RNA, 1413 nt, Artificial Sequence
  neuraminidase__InfluenzaA__ABK40560
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuuccuuuuguggcgugaauagugauacugcaaauuggucuuggccagacggugccgaguugccauucaccauugacaaguag

SEQ ID NO: 46069 - RNA, 1413 nt, Artificial Sequence; identical to SEQ ID NO: 45563
  neuraminidase__InfluenzaA__ABK40571

SEQ ID NO: 46070 - RNA, 1413 nt, Artificial Sequence
  neuraminidase__InfluenzaA__ABK40582
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacucaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 46071 - RNA, 1413 nt, Artificial Sequence
  neuraminidase__InfluenzaA__ABK40593
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucgcacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuauaaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 46072 - RNA, 1413 nt, Artificial Sequence; identical to SEQ ID NO: 45567
  neuraminidase__InfluenzaA__ABK40604

SEQ ID NO: 46073 - RNA, 1410 nt, Artificial Sequence; identical to SEQ ID NO: 45247
  neuraminidase__InfluenzaA__ABK40615

SEQ ID NO: 46074 - RNA, 1410 nt, Artificial Sequence; identical to SEQ ID NO: 44673
  neuraminidase__InfluenzaA__ABK40626

SEQ ID NO: 46075 - RNA, 1410 nt, Artificial Sequence
  neuraminidase__InfluenzaA__ABK40648
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguauuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 46076 - RNA, 1410 nt, Artificial Sequence
  neuraminidase__InfluenzaA__ABK40659
augaauccaaaucaaaagauaauaacaauuggcucuguuucucucacuauugccacaauaugcuuccuuaugcaaauugccauccugguaacuacuguaacauugcauuucaagcaauaugagugcaacucccccccaaacaaccaaguaaugcugugugaaccaacaauaauagaaagaaacauaacagagauaguguaucugaccaacaccaccauagagaaagaaauaugccccaaacuggcagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcgugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagacagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcucaaauaggcccaucguagauauaaaugugaaagauuauagcauuguuuccaguuaugugugcucaggacuuguuggagacacacccagaaaaaacgacagcuccagcaguagcuauugcuggaauccuaacaaugagaaagggggucauggagugaaaggcugggccuuugaugauggaaaugacguguggaugggaagaacgaucagcgaggagucacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 46077 - RNA, 1410 nt, Artificial Sequence; identical to SEQ ID NO: 45666
  neuraminidase__InfluenzaA__ABK40681

SEQ ID NO: 46078 - RNA, 1413 nt, Artificial Sequence
  neuraminidase__InfluenzaA__ABK40692
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguugggaaaagcgaauauugagaacacaagagucugaaugugucugugugaacgggucauguuucaccauaaugaccgauggcccaaguaauggggccgccucguacaaaaucuucaagaucgaaaagggaaagguuacuaaaucaguagaguuaaaugcacccaauuuucauuaugaggaauguuccuguuacccagacacuggcacaguaauguguguaugcagggacaacuggcaugguucaaaucgaccuugggugucuuuuaaucaaaacuuggauuaucaaauaggauacaucugcaguggaguguucggugacaauccgcgccccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguugacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46079 - RNA, 1410 nt, Artificial Sequence
  neuraminidase__InfluenzaA__ABK40703
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacaggggacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46080 - RNA, 1410 nt, Artificial Sequence; identical to SEQ ID NO: 45247
  neuraminidase__InfluenzaA__ABK40714

SEQ ID NO: 46081 - RNA, 1410 nt, Artificial Sequence
  neuraminidase__InfluenzaA__ABK40725
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggagggaaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46082 - RNA, 1410 nt, Artificial Sequence; identical to SEQ ID NO: 45247
  neuraminidase__InfluenzaA__ABK40736

SEQ ID NO: 46083 - RNA, 1410 nt, Artificial Sequence; identical to SEQ ID NO: 45949
  neuraminidase__InfluenzaA__ABK40747

SEQ ID NO: 46084 - RNA, 1413 nt, Artificial Sequence; identical to SEQ ID NO: 45455
  neuraminidase__InfluenzaA__ABK79951

SEQ ID NO: 46085 - RNA, 1413 nt, Artificial Sequence; identical to SEQ ID NO: 46062
  neuraminidase__InfluenzaA__ABK79973

SEQ ID NO: 46086 - RNA, 1410 nt, Artificial Sequence; identical to SEQ ID NO: 45247
  neuraminidase__InfluenzaA__ABK79984

SEQ ID NO: 46087 - RNA, 1410 nt, Artificial Sequence; identical to SEQ ID NO: 46044
  neuraminidase__InfluenzaA__ABK79995

SEQ ID NO: 46088 - RNA, 1413 nt, Artificial Sequence; identical to SEQ ID NO: 45563
  neuraminidase__InfluenzaA__ABK80028

SEQ ID NO: 46089 - RNA, 1413 nt, Artificial Sequence; identical to SEQ ID NO: 45563
  neuraminidase__InfluenzaA__ABK80039

SEQ ID NO: 46090 - RNA, 1413 nt, Artificial Sequence; identical to SEQ ID NO: 45563
  neuraminidase__InfluenzaA__ABK80050

SEQ ID NO: 46091 - RNA, 1410 nt, Artificial Sequence
  neuraminidase__InfluenzaA__ABK80061
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauucuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46092 - RNA, 1410 nt, Artificial Sequence; identical to SEQ ID NO: 44673
  neuraminidase__InfluenzaA__ABK80072

SEQ ID NO: 46093 - RNA, 1410 nt, Artificial Sequence
  neuraminidase__InfluenzaA__ABK80083
augaauccaaaucaaaagauaauaacgauuggcucaguuucucucaccauugccacaauaugcuuccuuaugcaaauugccauccugguaacuacuguaacauugcauuucaagcaauaugaaugcagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaagggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46094 - RNA, 1410 nt, Artificial Sequence
  neuraminidase__InfluenzaA__ABK80094
augaauccaaaucaaaagauaauaacgauuggcucuguuucucucaucauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46095 - RNA, 1410 nt, Artificial Sequence; identical to SEQ ID NO: 45247
  neuraminidase__InfluenzaA__ABK80105

SEQ ID NO: 46096 - RNA, 1410 nt, Artificial Sequence
  neuraminidase__InfluenzaA__ABK80138
augaauccaaaucaaaagauaauaacaauuggcucuguuucucucaccauugccacaauaugcuuccuuaugcaaacugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46097 - RNA, 1410 nt, Artificial Sequence
  neuraminidase__InfluenzaA__ABK80149
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaagcaaugcuguaugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46098 - RNA, 1410 nt, Artificial Sequence; identical to SEQ ID NO: 46097
  neuraminidase__InfluenzaA__ABK80160

SEQ ID NO: 46099 - RNA, 1410 nt, Artificial Sequence
  neuraminidase__InfluenzaA__ABK80171
augaauccaaaucaaaagauaauaacaauuggcucuguuucucucaccauugccacaauaugcuuccuuaugcaaauugccauccugguaacuacuguaacauugcauuucaagcaguaugaaugcaacccccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuuuuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46100 - RNA, 1410 nt, Artificial Sequence
  neuraminidase__InfluenzaA__ABK80182
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgaugggaaagcauggcugcauguuuguguaacuggggaugauaaaaaugcaacugcuagcuucauuuacaaugggaagcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46101 - RNA, 1410 nt, Artificial Sequence
  neuraminidase__InfluenzaA__ABK80193
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucggcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46102 - RNA, 1410 nt, Artificial Sequence
  neuraminidase__InfluenzaA__ABK80204
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaacgacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaagcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacgcguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46103 - RNA, 1410 nt, Artificial Sequence; identical to SEQ ID NO: 45095
  neuraminidase__InfluenzaA__ABK80215

SEQ ID NO: 46104 - RNA, 1410 nt, Artificial Sequence
  neuraminidase__InfluenzaA__ABK80226
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauagacaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46105 - RNA, 1410 nt, Artificial Sequence
  neuraminidase__InfluenzaA__ABK80237
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuucaaguuaugugugcucaggacuuguuggagacacacccagaaaaaccgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaccggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46106 - RNA, 1410 nt, Artificial Sequence
  neuraminidase__InfluenzaA__ABK80259
augaauccaaaucaaaagauaauaacaauuggcucugcuucucucaccauugccacaauaugcuuccuuauucaaauugcaauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaccaauuugcccuugggcagggaacaacacuaaacaacgggcauucaaaugacacaguacaugauaggaccccuuaccggaccuuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauuaguucaugguccaaaaaaauacucagaacccaggagucggaaugcguuuguaucaauggaacuuguacaguaguaaugacugaugggagcgcuucaggaaaagcugauacuaaaauauuauucauugaggaggggaaaaucauucauauuagcacauugucaggaagugcucagcaugucgaggagugcuccuguuauccucgauauccuggugucagaugugucugcagagacaauuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaauccuaauuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggauaucaaucucaugccuauauaa

SEQ ID NO: 46107 - RNA, 1410 nt, Artificial Sequence; identical to SEQ ID NO: 45977
  neuraminidase__InfluenzaA__ABK80270

SEQ ID NO: 46108 - RNA, 1410 nt, Artificial Sequence; identical to SEQ ID NO: 45218
  neuraminidase__InfluenzaA__ABK80281

SEQ ID NO: 46109 - RNA, 1410 nt, Artificial Sequence
  neuraminidase__InfluenzaA__ABK80292
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagaaguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46110 - RNA, 1410 nt, Artificial Sequence
  neuraminidase__InfluenzaA__ABK80303
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcuguaugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggaacgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46111 - RNA, 1410 nt, Artificial Sequence
  neuraminidase__InfluenzaA__ABK80314
augaauccaaaucaaaagauaauaacaauuggcucuguuucucucaccauugccacaauaugcuuccuuaugcaaauugccauccugguaacuacuguaacauugcauuucaagcaguaugaaugcgacucccccccaaacaaccaaguaaugcuguaugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46112 - RNA, 1350 nt, Artificial Sequence
  neuraminidase__InfluenzaA__ABL07021
augaauccaaaucagaagauaauaaccauuggaucaaucuguaugguaauuggaauaguuagcuuaauguuacaaauugggaacaugaucucaauaugggucagucauucaauucagaaagggaaucaacaccaagcugaaucaaucagcaauacuaacccucuuacugagaaagcuguggcuucaauaacauuagcgggcaauucaucucuuugccccauuagaggaugggcuguacacaguaaggacaacaauauaaggaucgguuccaagggggauguguuuguuauuagagagccguucaucucaugcucccaccuggaauguagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaaugaaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguauccuucaaucaaaauuuggaguaccaaauaggauauauaugcaguggaguuuucggagacaauccacgccccaaugauggaacagguaguuguggcccgauguccccuaauggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggacuagauugcauaagaccuuguuucuggguugaguuaaucagagggcggcccaaagagagcacaauuuggacuagugggaguagcauauccuuuugugguguaaauagugacacugugagcuggucuuggccagacggugcugaguugccauucaccauugacaaguag

SEQ ID NO: 46113 - RNA, 1350 nt, Artificial Sequence
  neuraminidase__InfluenzaA__ABL07032
augaauccaaaucagaagauaauaaccauuggaucaaucuguaugguaauuggaauaguuaguuuaauguuacaaauugggaacauggucucaacaugggucagucauucaauucagacagggaaucaauaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugaggacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 46114 - RNA, 1350 nt, Artificial Sequence
  neuraminidase__InfluenzaA__ABL31746
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucucacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggggccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaacaguugguugacaauuggaauuucuggcccagacaaugaggcuguggcuguauugaaauacaauggcauaauaacagacacuaucaagaguuggaggaaaaacauacugagaacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcucuuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacugacaguagcuuuucagugaaacaagauauaguagcaauaacugauuggucaggauauagcgggaguuuuguccagcauccagaacugacaggauuagacugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 46115 - RNA, 1350 nt, Artificial Sequence
  neuraminidase__InfluenzaA__ABL31757
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugaggacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 46116 - RNA, 1350 nt, Artificial Sequence; identical to SEQ ID NO: 46115
  neuraminidase__InfluenzaA__ABL31768

SEQ ID NO: 46117 - RNA, 1410 nt, Artificial Sequence
  neuraminidase__InfluenzaA__ABL67168
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucuggguaacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagaucccaacaaugaggaagguggucauggagugaaaggcugggccuuugaugauggaaaugacguguggaugggaagaacaaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46118 - RNA, 1410 nt, Artificial Sequence; identical to SEQ ID NO: 45247
  neuraminidase__InfluenzaA__ABL67179

SEQ ID NO: 46119 - RNA, 1413 nt, Artificial Sequence; identical to SEQ ID NO: 46062
  neuraminidase__InfluenzaA__ABL67190

SEQ ID NO: 46120 - RNA, 1410 nt, Artificial Sequence
  neuraminidase__InfluenzaA__ABL67201
augaauccaaaucaaaagauaauaacgauuagcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguauuugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaagaaacugaagucuuguggaccucaaacaguauuguuguguuuuguggcaccucagguacauauggaacaggcucauggccugauggggcggacaucaaucucaugccuauauaa

SEQ ID NO: 46121 - RNA, 1413 nt, Artificial Sequence; identical to SEQ ID NO: 46060
  neuraminidase__InfluenzaA__ABL67212

SEQ ID NO: 46122 - RNA, 1413 nt, Artificial Sequence; identical to SEQ ID NO: 45563
  neuraminidase__InfluenzaA__ABL67256

SEQ ID NO: 46123 - RNA, 1413 nt, Artificial Sequence; identical to SEQ ID NO: 45563
  neuraminidase__InfluenzaA__ABL67267

SEQ ID NO: 46124 - RNA, 1410 nt, Artificial Sequence; identical to SEQ ID NO: 44673
  neuraminidase__InfluenzaA__ABL67278

SEQ ID NO: 46125 - RNA, 1410 nt, Artificial Sequence
  neuraminidase__InfluenzaA__ABL67289
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcuguaugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46126 - RNA, 1410 nt, Artificial Sequence
  neuraminidase__InfluenzaA__ABL67300
augaauccaaaucaaaagauaauaacaauuggcucuguuucccucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46127 - RNA, 1410 nt, Artificial Sequence
  neuraminidase__InfluenzaA__ABL67311
augaauccaaaucaaaagauaauaacaauuggcucuguuucccucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcgucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacaguuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46128 - RNA, 1410 nt, Artificial Sequence
  neuraminidase__InfluenzaA__ABL67322
augaauccaaaucaaaagauaauaacaauuggcucuguuucucucaccauugccacaauaugcuuccuuaugcaaauugccauccugguaacuacuguaacauugcauuucaagcaguaugaaugcaacccccccccaaacaaccaaguaaugcugugugaaccaacaauaauagaaagaaacauaacagagauaguguaucugaccaacacuaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46129 - RNA, 1410 nt, Artificial Sequence
  neuraminidase__InfluenzaA__ABL67333
augaauccaaaucaaaagauaauaacaauuggcucuguuucucucaccauugccacaauaugcuuccuuaugcaaauugccauccugguaauuacuguaacauugcauuucaagcaguaugaaugcaacucccccccaaacaaccaaguaaugcugugugaaccaacaauaauagaaagaaacauaacagagauaguguaucugaccaacaccaccauagagaaagaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaagcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46130 - RNA, 1410 nt, Artificial Sequence
  neuraminidase__InfluenzaA__ABL67344
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaagauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46131 - RNA, 1410 nt, Artificial Sequence
  neuraminidase__InfluenzaA__ABL67355
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugaaaaguguuaucaauuugcccuugggcagggaacaacacuaaacaacgggcauucaaaugacacaguacaugauaggaccccuuaccggacccuauugaugaaugaauuggguguuccauuucauuugggaaccaagcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46132 - RNA, 1410 nt, Artificial Sequence
  neuraminidase__InfluenzaA__ABL67366
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugugauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuagaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggggugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46133 - RNA, 1410 nt, Artificial Sequence
  neuraminidase__InfluenzaA__ABL67377
augaauccaaaucaaaagauaauaacaauuggcucugcuucucucaccauugccauaauaugcuuccuuauucaaauugcaauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaccaauuugcccuugggcagggaacaacacuaaacaacgggcauucaaaugacacaguacaugauaggaccccuuaccggaccuuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauuaguucaugguccaaaaaaauacucagaacccaggagucggaaugcguuuguaucaauggaacuuguacaguaguaaugacugaugggagcgcuucaggaaaagcugacacuaaaauauuauucauugaggaggggaaaaucauucauauuagcacauugucaggaagugcucagcaugucgaggagugcuccuguuauccucgauauccuggugucagaugugucugcagagacaauuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaauccuaauuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggaucucaaucucaugccuauauaa

SEQ ID NO: 46134 - RNA, 1410 nt, Artificial Sequence
  neuraminidase__InfluenzaA__ABL67388
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucaggugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46135 - RNA, 1410 nt, Artificial Sequence; identical to SEQ ID NO: 45977
  neuraminidase__InfluenzaA__ABL67399

SEQ ID NO: 46136 - RNA, 1410 nt, Artificial Sequence
  neuraminidase__InfluenzaA__ABL67410
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgacggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46137 - RNA, 1410 nt, Artificial Sequence
  neuraminidase__InfluenzaA__ABL67421
augaauccaaaucaaaagauaauaacgauuggcucuauuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46138 - RNA, 1350 nt, Artificial Sequence
  neuraminidase__InfluenzaA__ABL67772
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguauacaguaaggacaauaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuugaaguaucaaauaggauauauaugcaguggagucuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46139 - RNA, 1350 nt, Artificial Sequence
  neuraminidase__InfluenzaA__ABL67783
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaguggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46140 - RNA, 1350 nt, Artificial Sequence
  neuraminidase__InfluenzaA__ABL67796
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuagaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccuauaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46141 - RNA, 1350 nt, Artificial Sequence
  neuraminidase__InfluenzaA__ABL67807
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaaucuucuuacugagaaagcuguggcuucaguaaaauuagcgggcaauucaucucuuugccccauugauggaugggcuguauacaguaaggacaacaguauaaggaucgguuccaagggggauguguuuguuguaagagagccauucaucucaugcucccacuuggaaugcagaacuuucuuuuugacucagggagccuugcugaaugacaagcacuccaaugggacugucaaagacagaaguccucacagaacauuaaugaguuguccugugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaaggaaaagugguuaaaucagucgaauuggaugcucccaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggagcagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46142 - RNA, 1350 nt, Artificial Sequence
  neuraminidase__InfluenzaA__ABL67818
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaaucuucuuacugagaaagcuguggcuucaguaaaauuagcgggcaauucaucucuuugccccauugauggaugggcuguauacaguaaggacaacaguauaaggaucgguuccaagggggauguguuuguuguaagagagccauucaucucaugcucccacuuggaaugcagaacuuucuuuuugacucagggagccuugcugaaugacaagcacuccaaugggacugucaaagacagaaguccucacagaacauuaaugaguuguccugugggugaggcucccuccccauacaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcuauugcuuuacuguaaugacugacggaccaaguaauggucaggcaucacauaagaucuucaaaauggaaaaaggaaaagugguuaaaucagucgaauuggaugcucccaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggagcagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46143 - RNA, 1350 nt, Artificial Sequence
  neuraminidase__InfluenzaA__ABL67829
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaaucuucuuacugagaaagcuguggcuucaguaaaauuagcgggcaauucaucucuuugccccauuaauggaugggcuguauacaguaaggacaacaguauaaggaucgguuccaagggggauguguuuguuguaagagagccauucaucucaugcucccacuuggaaugcagaacuuucuuuuugacucagggagccuugcugaaugacaagcacuccaaugggacugucaaagacagaaguccucacagaacauuaaugaguuguccugugggugaggcucccuccccauacaacucaagguuugagucuguugcuuggucagcaagcgcuugccaugauggcaccaguugguugacaauuggaauuucuggcccagacaauggggcuguggcuguauugaaauacaauggcauaauaacagacacuaucaagagcuggaggaauaacauacugagaacucaagagucugaaugugcauguguaaauggcuuuugcuuuacuguaaugacugacggaccaagcaauggucaggcaucacauaagaucuucaaaauggaaaaaggaaaagugguuaaaucagucgaauuggaugcucccaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggagcagguaguugugguccgguggccucuaacggggcauaugggguaaaaggguuuucauuuaaauacggcaauggugucuggaucgggagaacaaaaagcacuaauuccaggagcggcuuugaaaugauuugggacccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46144 - RNA, 1410 nt, Artificial Sequence
  neuraminidase__InfluenzaA__ABM22018
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46145 - RNA, 1413 nt, Artificial Sequence; identical to SEQ ID NO: 46060
  neuraminidase__InfluenzaA__ABM22029

SEQ ID NO: 46146 - RNA, 1410 nt, Artificial Sequence; identical to SEQ ID NO: 45218
  neuraminidase__InfluenzaA__ABM22040

SEQ ID NO: 46147 - RNA, 1410 nt, Artificial Sequence
  neuraminidase__InfluenzaA__ABM22062
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcuguaugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggagaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46148 - RNA, 1410 nt, Artificial Sequence
  neuraminidase__InfluenzaA__ABM22073
augaauccaaaucaaaagauaauaacaauuggcucuguuucucucaccauugccacaauaugcuuccuuaugcaaauugccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuuaauuugggaaccaggcaagugugcauagcaugguccagcucaaguugucacgauggaaaagcauggcugcauguuuguguaacuggggaugaugaaaaugcaacugcuagcuucauuuacaaugggaagcuuguagauaguauugguucaugguccaaaaaaauacucagaacccaggagucggaaugcguuuguaucaauggaacuugugcaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugucuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcacuucagguacauauggaacaggcucauggccugauggggcggauaucaaucucaugccuauauaa

SEQ ID NO: 46149 - RNA, 1410 nt, Artificial Sequence; identical to SEQ ID NO: 45095
  neuraminidase__InfluenzaA__ABM22084

SEQ ID NO: 46150 - RNA, 1410 nt, Artificial Sequence
  neuraminidase__InfluenzaA__ABM22095
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaagcaaugcugugugaaccaacaauaauagaaagaaacauaacagagauaguacaucugaccaacaccaccauagagaaggaaauaugccccaaacuaguagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46151 - RNA, 1410 nt, Artificial Sequence; identical to SEQ ID NO: 45095
  neuraminidase__InfluenzaA__ABM22106

SEQ ID NO: 46152 - RNA, 1410 nt, Artificial Sequence; identical to SEQ ID NO: 45095
  neuraminidase__InfluenzaA__ABM22117

SEQ ID NO: 46153 - RNA, 1410 nt, Artificial Sequence
  neuraminidase__InfluenzaA__ABM22128
augaauccaaaucaaaagauaauaacaauuggcucugcuucucucaccauugccacaauaugcuuccuuauucaaauugcaauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaccaauuugcccuugggcagggaacaacacuaaacaacgggcauucaaaugacacaguacaugauaggaccccuuaccggaccuuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauuaguucgugguccaaaaaaauacucagaacccaggagucggaaugcguuuguaucaauggaacuuguacaguaguaaugacugaugggagcgcuucaggaaaagcugauacuaaaauauuauucauugaggaggggaaaaucauucauauuagcacauugucaggaagugcucagcaugucgaggagugcuccuguuauccucgauauccuggugucagaugugucugcagagacaauuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaauccuaauuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggagcggauaucaaucucaugccuauauaa

SEQ ID NO: 46154 - RNA, 1410 nt, Artificial Sequence
  neuraminidase__InfluenzaA__ABM22139
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuagguguuccauuucaucuggggaccaagcaagugugcauagcaugguccaguucaaguugucacgacggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucagaaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46155 - RNA, 1410 nt, Artificial Sequence
  neuraminidase__InfluenzaA__ABM22150
augaauccaaaucaaaagauaauaacgauuggcucuguuucucucaccauuuccacaauaugcuucuucaugcaaauugccaucuugauaacuacuguaacauugcauuuuaagcaauaugaauucaacucccucccaaacaaccaagugaugcugugugaaccaacaauaauagaaagaaacauaacagagauaguguaucugaccaacaccaccauagagaaggaaauaugccccgaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46156 - RNA, 1413 nt, Artificial Sequence; identical to SEQ ID NO: 45563
  neuraminidase__InfluenzaA__ABM22161

SEQ ID NO: 46157 - RNA, 1413 nt, Artificial Sequence
  neuraminidase__InfluenzaA__ABM22172
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacacuggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaagacaacaaucuggacuagugggagcagcauuucuuuuuguggagugaauagugauacugcaaauuggucuuggccagacggugccgaguugccauucaccauugacaaguag

SEQ ID NO: 46158 - RNA, 1413 nt, Artificial Sequence; identical to SEQ ID NO: 45563
  neuraminidase__InfluenzaA__ABM22183

SEQ ID NO: 46159 - RNA, 1413 nt, Artificial Sequence
  neuraminidase__InfluenzaA__ABM22194
augaauccaaaucagaaaauaauaaccauuggaucaaucuguaugacaaucggaauaauuagucuaauauugcaaauaggaaauauuauuucaauaugggucagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaagacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagaaucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuagacuguaugaggccuugcuucuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 46160 - RNA, 1413 nt, Artificial Sequence; identical to SEQ ID NO: 45563
  neuraminidase__InfluenzaA__ABM22205

SEQ ID NO: 46161 - RNA, 1413 nt, Artificial Sequence; identical to SEQ ID NO: 45563
  neuraminidase__InfluenzaA__ABM22216

SEQ ID NO: 46162 - RNA, 1413 nt, Artificial Sequence; identical to SEQ ID NO: 45567
  neuraminidase__InfluenzaA__ABM22227

SEQ ID NO: 46163 - RNA, 1413 nt, Artificial Sequence; identical to SEQ ID NO: 46068
  neuraminidase__InfluenzaA__ABM22238

SEQ ID NO: 46164 - RNA, 1413 nt, Artificial Sequence
  neuraminidase__InfluenzaA__ABM22271
augaauccaaaucaaaaaauaauaaccauuggaucaaucaguauuguaauuggaauaauuagucugauauugcaaauaggaaauauuauuucaauaugggcuagccacucaauccaaacuggaagucaaaaccacacuggaauaugcaaccaaagaaucauuacauaugagaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaagggagaguuacuaaaucaauagaguugggugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46165 - RNA, 1413 nt, Artificial Sequence; identical to SEQ ID NO: 45472
  neuraminidase__InfluenzaA__ABM22282

SEQ ID NO: 46166 - RNA, 1410 nt, Artificial Sequence; identical to SEQ ID NO: 44849
  neuraminidase__InfluenzaA__ABM22304

SEQ ID NO: 46167 - RNA, 1410 nt, Artificial Sequence; identical to SEQ ID NO: 44849
  neuraminidase__InfluenzaA__ABM22315

SEQ ID NO: 46168 - RNA, 1410 nt, Artificial Sequence; identical to SEQ ID NO: 44849
  neuraminidase__InfluenzaA__ABM22326

SEQ ID NO: 46169 - RNA, 1410 nt, Artificial Sequence; identical to SEQ ID NO: 44849
  neuraminidase__InfluenzaA__ABM22337

SEQ ID NO: 46170 - RNA, 1410 nt, Artificial Sequence; identical to SEQ ID NO: 44850
  neuraminidase__InfluenzaA__ABM22348

SEQ ID NO: 46171 - RNA, 1410 nt, Artificial Sequence; identical to SEQ ID NO: 44850
  neuraminidase__InfluenzaA__ABM22359

SEQ ID NO: 46172 - RNA, 1410 nt, Artificial Sequence; identical to SEQ ID NO: 44899
  neuraminidase__InfluenzaA__ABM22370

SEQ ID NO: 46173 - RNA, 1413 nt, Artificial Sequence; identical to SEQ ID NO: 45429
  neuraminidase__InfluenzaA__ABM66867

SEQ ID NO: 46174 - RNA, 1413 nt, Artificial Sequence; identical to SEQ ID NO: 45567
  neuraminidase__InfluenzaA__ABM66900

SEQ ID NO: 46175 - RNA, 1413 nt, Artificial Sequence; identical to SEQ ID NO: 45563
  neuraminidase__InfluenzaA__ABM66911

SEQ ID NO: 46176 - RNA, 1410 nt, Artificial Sequence; identical to SEQ ID NO: 44850
  neuraminidase__InfluenzaA__ABM66922

SEQ ID NO: 46177 - RNA, 1410 nt, Artificial Sequence; identical to SEQ ID NO: 44850
  neuraminidase__InfluenzaA__ABM66933

SEQ ID NO: 46178 - RNA, 1410 nt, Artificial Sequence; identical to SEQ ID NO: 44850
  neuraminidase__InfluenzaA__ABM66944

SEQ ID NO: 46179 - RNA, 1410 nt, Artificial Sequence; identical to SEQ ID NO: 44899
  neuraminidase__InfluenzaA__ABM66955

SEQ ID NO: 46180 - RNA, 1410 nt, Artificial Sequence; identical to SEQ ID NO: 44899
  neuraminidase__InfluenzaA__ABM66966

SEQ ID NO: 46181 - RNA, 1410 nt, Artificial Sequence; identical to SEQ ID NO: 44899
  neuraminidase__InfluenzaA__ABM66977

SEQ ID NO: 46182 - RNA, 1410 nt, Artificial Sequence; identical to SEQ ID NO: 44899
  neuraminidase__InfluenzaA__ABM66988

SEQ ID NO: 46183 - RNA, 1410 nt, Artificial Sequence; identical to SEQ ID NO: 44899
  neuraminidase__InfluenzaA__ABM66999

SEQ ID NO: 46184 - RNA, 1410 nt, Artificial Sequence; identical to SEQ ID NO: 44899
  neuraminidase__InfluenzaA__ABM67010

SEQ ID NO: 46185 - RNA, 1410 nt, Artificial Sequence; identical to SEQ ID NO: 44899
  neuraminidase__InfluenzaA__ABM67021

SEQ ID NO: 46186 - RNA, 1413 nt, Artificial Sequence
  neuraminidase__InfluenzaA__ABM67054
augaauccaaaucaaaaaauaauaaccauuggaucaaucaguauagcaaucggaacaauuagucuaauguugcaaauaggaaauaugauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaauuggcauggcucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46187 - RNA, 1350 nt, Artificial Sequence
  neuraminidase__InfluenzaA__ABM68048
augaauccaaaucagaagauaauaaccaucggaucaaucuguaugguaauuggaauaguuagcuuaauguuacaaauugggaacauaaucucaauauggaucagucauucaauucaaacagggaaucaaugccaagcuggaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagucguucaucucaugcucccacuuggaaugcagaacuuucuuuuugacucagggagccuugcugaaugacaagcacuccaauggaacugucaaagacagaagcccucacagaacauuaaugaguuguccugugggugaggcucccucuccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguaaugggcaggcaucauauaagaucuucaaaauggaaaaggggaaagugguuaaaucagucgaauuggaugcuccuaauuaucacuaugaggagugcuccuguuauccugaugccggugaaaucacgugugugugcagggauaguuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauauggaguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 46188 - RNA, 1350 nt, Artificial Sequence
  neuraminidase__InfluenzaA__ABM68049
augaauccaaaucagaagauaauaaccaucggaucaaucuguaugguaauuggaauaguuagcuuaauguuacaaauugggaacauaaucucaauauggaucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggugaaaucacgugugugugcagggauaguuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauauggaguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 46189 - RNA, 1350 nt, Artificial Sequence
  neuraminidase__InfluenzaA__ABM90436
augaauccaaaucagaagauaauaaccauuggaucaaucuguaugguaauuggaauaguuagcuuaauguuacaaauugggaacaugaucucaauaugggucagucauucaauucagaaagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaauguagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugaggacucaagagucugaaugugcauguguaaauggcucuugcuuuacuguaaugacugauggaccaaguaaugggcaggcaucauauaagaucuucaaaaugaaaaaaggaaaaguggucaaaucagucgaauuggaugcuccuaauuaucacuaugaggagugcuccuguuauccugaugccggcgaaaucacauguguuugcagggauaauuggcauggcucaaauaggccauggguauccuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacuuacaggauuagauugcauaagaccuuguuucuggguugaguuaaucagagggcggcccaaagagagcacaauuuggacuagugggaguagcauaucuuuuugugguguaaauagugacacugugagcuggucuuggccagacggugcugaguugccauucaccauugacaaguag

SEQ ID NO: 46190 - RNA, 1350 nt, Artificial Sequence; identical to SEQ ID NO: 46189
  neuraminidase__InfluenzaA__ABM90447

SEQ ID NO: 46191 - RNA, 1350 nt, Artificial Sequence; identical to SEQ ID NO: 46189
  neuraminidase__InfluenzaA__ABM90458

SEQ ID NO: 46192 - RNA, 1350 nt, Artificial Sequence; identical to SEQ ID NO: 46189
  neuraminidase__InfluenzaA__ABM90469

SEQ ID NO: 46193 - RNA, 1350 nt, Artificial Sequence
  neuraminidase__InfluenzaA__ABM90491
augaauccaaaucagaagauaauaaccauuggaucaaucuguaugguaauuggaauaguuagcuuaauguuacaaauugggaacaugaucucaauaugggucagucauucaauucaaaaagggaaucaacaccaagcugaaucaaucagcaauacuaacccucuuacugagaaagcuguggcuucaguaacauuagcgggcaauucaucucuuugccccauuagaggaugggcuguacacaguaaggacaacaauauaaggaucgguuccaagggggauguguuuguuauuagagagccguucaucucaugcucccaccuggaauguagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugagaacucaagagucugaaugugcauguguaaauggcucuugcuuuacuguaaugacugauggaccaaguaaugggcaggcaucauauaagaucuucaaaaugaaaaaaggaaaagugaucaaaucagucgaauuggaugcuacuaauuaucacuaugaggagugcuccuguuauccugaugccggcgaaaucacauguguuugcagggauaauuggcauggcucaaauaggccauggguauccuucaaucaaaauuuggaguaccaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggacuagauugcauaagaccuuguuucuggguugaguuaaucagagggcggcccaaagagagcacaauuuggacuagugggaguagcauaucuuuuugugguguaaauagugacacugugagcuggucuuggccagacggugcugaguugccauucaccauugacaaguag

SEQ ID NO: 46194 - RNA, 1350 nt, Artificial Sequence; identical to SEQ ID NO: 46193
  neuraminidase__InfluenzaA__ABM90502

SEQ ID NO: 46195 - RNA, 1350 nt, Artificial Sequence
  neuraminidase__InfluenzaA__ABM90524
augaauccaaaucagaagauaauaaccauuggaucaaucuguaugguaauuggaauaguuagcuuaauguuacaaauugggaacaugaucucaauaugggucagucauucaauucagacagggaaucaacaccaagcugaaucaaucagcaauacuaacccucuuacugagaaagcugugguuucaguaacauuagcgggcaauucaucucuuugccccauuagaggaugggcuguacacaguaaggacaacaauauaaggaucgguucaaagggggauguguuuguuauuagagagccguucaucucaugcucccaccuggaaugcagaacuuucuucuugacucagggagccuugcugaaugacaagcacuccaacgggacugucaaagacagaagcccucacagaacauuaaugaguuguccugugggugaggcucccucuccauauaacucaagguuugagucuguugcuuggucagcaagugcuugccaugauggcaccaguugguugacaauuggaauuucuggcccagacaaugaggcuguggcuguauugaaauacaauggcauaauaacagacacuaucaagaguuggaggaacaacauacugaggacucaagagucugaaugugcauguguaaauggcucuugcuuuacuguaaugacugauggaccaaguaaugggcaggcaucauauaagaucuucaaaauggaaaaaggaaaaguggucaaaucagucgaauuggaugcuccuaauuaucacuaugaggagugcuccuguuauccugaugccggcgaaaucacauguguuugcagggauaauuggcauggaucaaauaggccauggguaucuuucaaucaaaauuuggaguaucaaauaggauauauaugcaguggaguuuucggagacaauccacgccccaaugauggaacagguaguuguggcccgauguccccuaacggggcauaugggguaaaaggguuuucauuuaaauacggcaaugguguuuggaucgggagaaccaaaagcacuaacuccaggagcggcuuugaaaugauuugggauccaaauggguggacuggaacggacaguagcuuuucagugaaacaagauauaguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacugugaguuggucuuggccagacggugcugaguugccauucaccauugacaaguag

SEQ ID NO: 46196 - RNA, 1350 nt, Artificial Sequence; identical to SEQ ID NO: 46195
  neuraminidase__InfluenzaA__ABM90535

SEQ ID NO: 46197 - RNA, 1350 nt, Artificial Sequence; identical to SEQ ID NO: 46195
  neuraminidase__InfluenzaA__ABM90546

SEQ ID NO: 46198 - RNA, 1413 nt, Artificial Sequence
  neuraminidase__InfluenzaA__ABN50759
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggcaggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacaguggaaguuuuguucaacauccugagcuaacaggauuggacuguauaaggccuugcuucuggguugaauuaaucagaggacgacccagagaaaaaacaacaaucuggacuagugggagcagcauuucuuuuuguggcgugaauagugauacuguaaauuggucuuggccagacggugcugaguugccauucaccauugacaaguag

SEQ ID NO: 46199 - RNA, 1410 nt, Artificial Sequence
  neuraminidase__InfluenzaA__ABN50770
augaauccaaaucaaaagauaauaacgauuggcucuguuucucucaccauuuccacaauaugcuucuucaugcaaauugccaucuugauaacuacuguaacauugcacuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaauuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46200 - RNA, 1413 nt, Artificial Sequence
  neuraminidase__InfluenzaA__ABN50903
augaauccaaaucagaaaauaauuaccauuggaucaaucuguauggcaaucgggauaauuagucuaauauugcaaauaggaaauauuauuucaauauggguuagccacucaauccaaacuggaagucaaaaccacacuggaauaugcaaccaaagaaucaucaccuaugaaaauagcaccuggguaaaucaaacauauguuaauauuaacaacacuaacguuguugcuggaaaggacacaacuucagugacacuagccggcaauucaucucuuuguccuguccgugggugggcuauauacagcaaagacaacagcauaagaauugguuccaaaggagauguuuuugucauaagagaaccuuuuauaucauguucucacuuggaaugcagaaccuuuuuucuaacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucuggaccagaugauggagcaguggcuguacuaaaauacaacggcauaauaacugaaaccauaaaaaguuggaggaaacgaauauuaagaacacaagagucugaaugugucuguguaaacgguucauguuuuaccauaaugaccgauggcccaaguaaugggccggccucguacagaaucuucaaaaucgagaaggggaaaauuacuaaaucaauagaguuggaugcacccaauucucacuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugguccaguaacuguugauggagcagacggaguaaagggguuuucauacagguaugguaauggugucuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucauucaacauccugagcuaacaggauuggacuguaugaggccuugcuucuggguugaauuaaucagaggacgaccuagagaaaagacaacaaucuggacuagugggaguagcauuucuuuuuguggcgugaauagugauacuguaaauuggucuuggccagacggugccgaguugccauucaccauugacaaguag

SEQ ID NO: 46201 - RNA, 1413 nt, Artificial Sequence; identical to SEQ ID NO: 45563
  neuraminidase__InfluenzaA__ABN50920

SEQ ID NO: 46202 - RNA, 1413 nt, Artificial Sequence
  neuraminidase__InfluenzaA__ABN50931
augaauccaaaucagaaaauaauaaccauaggaucaaucuguauggcaauaggaauaauuagucuaauauugcaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggggauguuuuugucauaagagaaccuuuuauaucauguucucacuuggaaugcagaaccuuuuuucugacccaaggugcucuauuaaaugacaagcauucaaacggaaccguuaaggacagaagcccuuauagggccuuaaugagcuguccuauaggugaagcuccgucucccuacaauucaagauuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugguccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaauuacugauuggucaggguacagcggaagcuucguucaacauccugaacuaacaggauuagauuguaugaggccuugcuucuggguugaauugaucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 46203 - RNA, 1413 nt, Artificial Sequence
  neuraminidase__InfluenzaA__ABN50943
augaauccaaaucagaaaauaauaaccauaggaucaaucuguauggcaauaggaauaauuagucuaauauugcaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaacggaaccguuaaggacagaagcccuuauagggccuuaaugagcuguccuauaggugaagcuccgucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugguccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggagugaauggugauacugcaaauuggucuuggccagacggugccgaguugccauucaccauugacaaguag

SEQ ID NO: 46204 - RNA, 1413 nt, Artificial Sequence
  neuraminidase__InfluenzaA__ABN50954
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugagaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46205 - RNA, 1413 nt, Artificial Sequence; identical to SEQ ID NO: 45472
  neuraminidase__InfluenzaA__ABN50965

SEQ ID NO: 46206 - RNA, 1413 nt, Artificial Sequence; identical to SEQ ID NO: 45472
  neuraminidase__InfluenzaA__ABN50976

SEQ ID NO: 46207 - RNA, 1410 nt, Artificial Sequence; identical to SEQ ID NO: 44849
  neuraminidase__InfluenzaA__ABN50987

SEQ ID NO: 46208 - RNA, 1410 nt, Artificial Sequence; identical to SEQ ID NO: 44850
  neuraminidase__InfluenzaA__ABN50998

SEQ ID NO: 46209 - RNA, 1410 nt, Artificial Sequence
  neuraminidase__InfluenzaA__ABN51013
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccuuugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 46210 - RNA, 1410 nt, Artificial Sequence
  neuraminidase__InfluenzaA__ABN51024
augaauccaaaucaaaagauaauaacgauuggcucuguuucucucaccguuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46211 - RNA, 1410 nt, Artificial Sequence
  neuraminidase__InfluenzaA__ABN51035
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 46212 - RNA, 1410 nt, Artificial Sequence; identical to SEQ ID NO: 46211
  neuraminidase__InfluenzaA__ABN51046

SEQ ID NO: 46213 - RNA, 1413 nt, Artificial Sequence
  neuraminidase__InfluenzaA__ABN51069
augaauccaaaucaaaaaauaauaaccauuggaucaaucaguauugcaauuggaauaauuagucugauauugcaaauaggaaauauuauuucaauaugggccagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucuguagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugguuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagggggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46214 - RNA, 1413 nt, Artificial Sequence
  neuraminidase__InfluenzaA__ABN51080
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcugaaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaacuauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaguagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaauggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugacuggucaggguacagcggaaguuucguucaacauccugaguuaacaggauuggacuguauaagaccuugcuucuggguugaguuagucagaggacugccuaaagaaaauacaacaaucuggacuagugggagcagcauuucuuuuuguggcguaaauagugauacugcaaacuggucuuggccagacggugcugaguugccguucaccauugacaaguag

SEQ ID NO: 46215 - RNA, 1413 nt, Artificial Sequence
  neuraminidase__InfluenzaA__ABN51091
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagccccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagaugggaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46216 - RNA, 1410 nt, Artificial Sequence
  neuraminidase__InfluenzaA__ABN51102
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccagacaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46217 - RNA, 1410 nt, Artificial Sequence
  neuraminidase__InfluenzaA__ABN51113
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccacaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggggugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46218 - RNA, 1410 nt, Artificial Sequence
  neuraminidase__InfluenzaA__ABN51124
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagagucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggaccugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46219 - RNA, 1410 nt, Artificial Sequence
  neuraminidase__InfluenzaA__ABN51135
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaucaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46220 - RNA, 1413 nt, Artificial Sequence
  neuraminidase__InfluenzaA__ABN51146
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaauaa

SEQ ID NO: 46221 - RNA, 1410 nt, Artificial Sequence
  neuraminidase__InfluenzaA__ABN51157
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucuaaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucacuugggaaccaggcaagugugcauagcaugguccagcucaaguugucacgauggaaaagcauggcugcauguuuguguaacuggggaugaugaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugaaacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46222 - RNA, 1410 nt, Artificial Sequence; identical to SEQ ID NO: 46210
  neuraminidase__InfluenzaA__ABN59393

SEQ ID NO: 46223 - RNA, 1365 nt, Artificial Sequence
  neuraminidase__InfluenzaA__ABN59415
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 46224 - RNA, 1413 nt, Artificial Sequence
  neuraminidase__InfluenzaA__ABN59426
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcugggaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46225 - RNA, 1410 nt, Artificial Sequence; identical to SEQ ID NO: 45292
  neuraminidase__InfluenzaA__ABO32659

SEQ ID NO: 46226 - RNA, 1410 nt, Artificial Sequence
  neuraminidase__InfluenzaA__ABO32670
augaauccaaaucaaaagauaauaacgauuggcucuguuucucucaccauuuccacaauaugcuucuuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggaccuuauugaugaaugaguuggguguuccauuucauauggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaauauaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46227 - RNA, 1413 nt, Artificial Sequence; identical to SEQ ID NO: 46078
  neuraminidase__InfluenzaA__ABO32681

SEQ ID NO: 46228 - RNA, 1410 nt, Artificial Sequence
  neuraminidase__InfluenzaA__ABO32695
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguagugaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcucggauccuaacaaugaagaagguggucauggagugaaaggcugggccuuugaugauggaaaugacguguggaugggaagaacgaucagcgagaaguuacgcucaggauaugaaaccuucaaagucaucgaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46229 - RNA, 1410 nt, Artificial Sequence; identical to SEQ ID NO: 45247
  neuraminidase__InfluenzaA__ABO32754

SEQ ID NO: 46230 - RNA, 1410 nt, Artificial Sequence; identical to SEQ ID NO: 45247
  neuraminidase__InfluenzaA__ABO32765

SEQ ID NO: 46231 - RNA, 1410 nt, Artificial Sequence; identical to SEQ ID NO: 46106
  neuraminidase__InfluenzaA__ABO32778

SEQ ID NO: 46232 - RNA, 1410 nt, Artificial Sequence
  neuraminidase__InfluenzaA__ABO32793
augaauccaaaucaaaagauaauaacgauuggcucuguuucucucaccauuuccacaauaugcuucuuuaugcaaauugucaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuugugugacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaaacugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46233 - RNA, 1410 nt, Artificial Sequence; identical to SEQ ID NO: 45977
  neuraminidase__InfluenzaA__ABO32806

SEQ ID NO: 46234 - RNA, 1410 nt, Artificial Sequence; identical to SEQ ID NO: 45218
  neuraminidase__InfluenzaA__ABO32819

SEQ ID NO: 46235 - RNA, 1410 nt, Artificial Sequence; identical to SEQ ID NO: 44899
  neuraminidase__InfluenzaA__ABO32830

SEQ ID NO: 46236 - RNA, 1410 nt, Artificial Sequence
  neuraminidase__InfluenzaA__ABO32841
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 46237 - RNA, 1410 nt, Artificial Sequence; identical to SEQ ID NO: 46236
  neuraminidase__InfluenzaA__ABO32852

SEQ ID NO: 46238 - RNA, 1410 nt, Artificial Sequence; identical to SEQ ID NO: 46236
  neuraminidase__InfluenzaA__ABO32863

SEQ ID NO: 46239 - RNA, 1410 nt, Artificial Sequence; identical to SEQ ID NO: 46210
  neuraminidase__InfluenzaA__ABO32874

SEQ ID NO: 46240 - RNA, 1410 nt, Artificial Sequence; identical to SEQ ID NO: 46210
  neuraminidase__InfluenzaA__ABO32885

SEQ ID NO: 46241 - RNA, 1410 nt, Artificial Sequence; identical to SEQ ID NO: 46211
  neuraminidase__InfluenzaA__ABO32896

SEQ ID NO: 46242 - RNA, 1410 nt, Artificial Sequence; identical to SEQ ID NO: 46211
  neuraminidase__InfluenzaA__ABO32907

SEQ ID NO: 46243 - RNA, 1410 nt, Artificial Sequence
  neuraminidase__InfluenzaA__ABO32918
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaacaugccccaaacuagcagaauacagaaauuggucaaagccgcaauguaacauuacaggauuugcacccuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucauggucuaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugaugggaaugacguguggaugggaagaacgaucagcgagaaguuacgcucaggauaugaaaccuucaaagucauugaaggcugguccaacucuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46244 - RNA, 1410 nt, Artificial Sequence; identical to SEQ ID NO: 46243
  neuraminidase__InfluenzaA__ABO32929

SEQ ID NO: 46245 - RNA, 1410 nt, Artificial Sequence; identical to SEQ ID NO: 46243
  neuraminidase__InfluenzaA__ABO32940

SEQ ID NO: 46246 - RNA, 1413 nt, Artificial Sequence
  neuraminidase__InfluenzaA__ABO32951
augaauccaaaucaaaaaauaauaaccauuggaucaaucaguauagcaaucggaauaauuaguuuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucgggauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcugcaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46247 - RNA, 1413 nt, Artificial Sequence
  neuraminidase__InfluenzaA__ABO32962
augaauccaaaucaaaaaauaauaaccauuggaucaaucaguauagcaaucggaauaauuagucuaauguugcaaauaggaaauauuauuucaauaugggcuagucacucaauccaaacuggaaguaaaaaccacacuggaguaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauugguuccaaaggagauguguuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaaacgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagauaaaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugagacaggauguuguggcaauaacugauuggucaggauacagcggaaguuucguucaacauccugaguuaacaggauuggacuguauaagaccuugcuucuggguugaguuagucagaggacugccuagagagaauacaacaaucuggacuagugggagcagcauuucuuuuuguggcguaaauagugauacugcaaacuggucuuggccagacggugcugaguugccguucaccauugacaaguag

SEQ ID NO: 46248 - RNA, 1413 nt, Artificial Sequence; identical to SEQ ID NO: 46035
  neuraminidase__InfluenzaA__ABO32973

SEQ ID NO: 46249 - RNA, 1413 nt, Artificial Sequence
  neuraminidase__InfluenzaA__ABO32984
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46250 - RNA, 1413 nt, Artificial Sequence
  neuraminidase__InfluenzaA__ABO32995
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucaccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46251 - RNA, 1413 nt, Artificial Sequence
  neuraminidase__InfluenzaA__ABO33009
augaauccaaaccagaaaauaauaaccauuggaucaaucuguauggcaaucggaaugauuagucuaauauugcaaauagggaauauuaucucaauauggguuagccacucaauucaaacuggaagucaaaaccauacugggauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuguuaaaugacaagcauucaaaugggaccguuaaggacagaagcccuuauagggccuuaaugagcugcccuauaggugaagcuccgucuccauacaauucaagguuugaaucaguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgacaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46252 - RNA, 1410 nt, Artificial Sequence; identical to SEQ ID NO: 46022
  neuraminidase__InfluenzaA__ABO33039

SEQ ID NO: 46253 - RNA, 1410 nt, Artificial Sequence
  neuraminidase__InfluenzaA__ABO33050
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46254 - RNA, 1410 nt, Artificial Sequence; identical to SEQ ID NO: 45247
  neuraminidase__InfluenzaA__ABO33061

SEQ ID NO: 46255 - RNA, 1410 nt, Artificial Sequence
  neuraminidase__InfluenzaA__ABO33072
augaauccaaaucaaaagauaauaacaauuggcucugucucucucaccauugcaacaauaugcuuccucaugcaaauugccaucuugguaacuacuguaacauugcauuucaagcaauaugagugcggcucccccgcaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugacgauggaaaugacguguggaugggaagaacgaucagcgaggagucacgcucagguuaugaaaccuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 46256 - RNA, 1413 nt, Artificial Sequence; identical to SEQ ID NO: 46157
  neuraminidase__InfluenzaA__ABO37991

SEQ ID NO: 46257 - RNA, 1413 nt, Artificial Sequence
  neuraminidase__InfluenzaA__ABO38013
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauaugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46258 - RNA, 1413 nt, Artificial Sequence
  neuraminidase__InfluenzaA__ABO38024
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugagaacaacaccugggugaaucacacguauguuaauauuaacaacacuaauauuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauaucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggcugccucguacaaaaucuucaagaucgaaaaagggaaaguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggggcagacggaguaaagggguuuucauacaaauaugguaaugguguuuggauaggaaggacuaaaaguaacagacuuagaaagggguuugagaugguuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46259 - RNA, 1413 nt, Artificial Sequence
  neuraminidase__InfluenzaA__ABO38035
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaacaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccaaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugaggugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggaaugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46260 - RNA, 1413 nt, Artificial Sequence; identical to SEQ ID NO: 45389
  neuraminidase__InfluenzaA__ABO38046

SEQ ID NO: 46261 - RNA, 1413 nt, Artificial Sequence
  neuraminidase__InfluenzaA__ABO38068
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucucuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46262 - RNA, 1410 nt, Artificial Sequence; identical to SEQ ID NO: 44870
  neuraminidase__InfluenzaA__ABO38079

SEQ ID NO: 46263 - RNA, 1410 nt, Artificial Sequence
  neuraminidase__InfluenzaA__ABO38090
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugaaaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46264 - RNA, 1410 nt, Artificial Sequence
  neuraminidase__InfluenzaA__ABO38101
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaagggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugccagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauaucagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46265 - RNA, 1410 nt, Artificial Sequence
  neuraminidase__InfluenzaA__ABO38233
augaauccaaaucaaaagauaauaacaauuggcucugucucucucaccauugcaacaauaugcuuccucaugcaaauugccauccugguaacuacuguaacauugcauuucaagcaauaugagugcgacucccccgcaaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaagcauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggauaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugauacuaaaauacuauucauugaagaggggaaaauuguucauauuagcccauugucaggaagugcucagcauguagaggaguguuccuguuauccucgauauccuggugucagaugugucugcagagacaacuggaaaggcucuaauaggcccgucguagauauaaaugugaaagauuauagcauugcuuccaguuaugugugcucagggcuuguuggcgacacacccagaaaaaacgacagauauagcaguagcuauugccggaauccuaacaaugagaaagggaaucauggagugaaaggcugggccuuugacgauggaaaugacguguggaugggaagaacgaucagcgaugagucacgcucagguuaugaaacuuucaaagucauuggugguugguccacaccuaauuccaaauugcagauaaauaggcaagucauaguugacagcgauaauagguccgguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggagcggacaucaaucucaugccuauauaa

SEQ ID NO: 46266 - RNA, 1410 nt, Artificial Sequence; identical to SEQ ID NO: 45615
  neuraminidase__InfluenzaA__ABO38244

SEQ ID NO: 46267 - RNA, 1410 nt, Artificial Sequence
  neuraminidase__InfluenzaA__ABO38255
augaauccaaaucaaaagauaauaacgauuggcucuguuucucucaccauuuccacaauaugcuucuuuaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46268 - RNA, 1410 nt, Artificial Sequence; identical to SEQ ID NO: 46236
  neuraminidase__InfluenzaA__ABO38277

SEQ ID NO: 46269 - RNA, 1410 nt, Artificial Sequence; identical to SEQ ID NO: 46243
  neuraminidase__InfluenzaA__ABO38288

SEQ ID NO: 46270 - RNA, 1410 nt, Artificial Sequence
  neuraminidase__InfluenzaA__ABO38299
augaauccaaaucaaaagauaauaacaauuggcucugucucucucaccauugcaacaguaugcuucaucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaagcaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauguagaggaguguuccuguuacccucgauauccugacgucagauguaccugcagagacaacuggaaaggcucuaauaggcccguuauagacauaaauauggaagauuauagcauugauuccaguuacgugugcucaggacuuguuggcgacacacccaggaacgacgacagcucuagcaauagcaauugcagggauccuaacaaugaaagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaaguugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46271 - RNA, 1410 nt, Artificial Sequence
  neuraminidase__InfluenzaA__ABO38310
augaauccaaaucaaaagauaauaacaauuggcucugucucucucaccauugcaacaguaugcuuccucaugcagauugccauccuggcaacuacugugacauugcauuuuaaacaacaugagugcgacucccccacgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacggcgacagcucuagcaauagcaauugcagggauccuaacaaugaaagagggaauccaggagugaaaggcugggccuuugacaauggagaugauguauggaugggaagaacaaucaacaaagaaucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46272 - RNA, 1413 nt, Artificial Sequence
  neuraminidase__InfluenzaA__ABO38332
augaauccaaaucaaaaaauaauaaccauuggaucaaucaguauagcaaucggaaugauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauacagacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 46273 - RNA, 1413 nt, Artificial Sequence
  neuraminidase__InfluenzaA__ABO38343
augaauccaaaucagaaaauaauaaccauuggaucaaucuguaugacaaucggaauaauuagucuaauauugcaaauaggaaauauuauuucaauauggguuagccacucaauccaaacuggaagucaaaaccacacuggaauaugcaaccaaagaaucauuacuuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguguucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuggucagaggacgaccuagagaggggacaacggucuggacuagugggagcagcauuucuuuuuguggcgugaauagugauacugcaaauuggucuuggccagacggugccgaguugccauucaccauugacaaguag

SEQ ID NO: 46274 - RNA, 1410 nt, Artificial Sequence
  neuraminidase__InfluenzaA__ABO38354
augaauccaaaucagaaaauaauaaccauuggaucaaucuguaugguagucggaauaauuagccuaauauugcaaauagggaauauaaucucaauauggauuagccauucaauucaaacuggaagucaaaaccauacuggaauaugcaaccaaaacaucauuaccuauaaaaauagcaccuggguaaaucaaacauauguuaauauuagcaacacuaacguuguugcuggacaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaggcauucaaaugggaccguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugagaacacaagagucugaaugugccuguguaaaugguucauguuuuacuauaaugacugauggcccgaguaaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcaugguucgaaccgaccaugggugucuuucgaucaaaaccuggauuaucaaauaggauacaucugcagugggguuuucggugacaauccgcgucccaaagauggaacaggcagcugugguccaguguauguugauggagcaaacggaguaaagggauuuucauauagguaugguaaugguguuuggauaggaaggaccaaaaguaacaguuccagacauggguuugagaugauuugggauccuaauggauggacagagacugauaguaaguucucugugagacaagauguuguggcaaugacugauuggucaggguauagcggaaguuucguucaacauccugagcuaacagggcuagacuguaugaggccgugcuucuggguugaauugaucaggggacgaccuaaagaaaacacaaucuggacuagugggagcagcauuucuuuuuguggcgugaauagugauacuguagauuggucuuggccagacggugcugaguugccauucaccauugacaaguag

SEQ ID NO: 46275 - RNA, 1413 nt, Artificial Sequence
  neuraminidase__InfluenzaA__ABO38365
augaauccaaaucagaaaauaauaaccauuggaucaaucuguauggcaaucggaauaauuagucuaauauugcaaaugggaaauauuauuucaauauggguuagccacucaauccaaacuggaagucaaaaccacacuggaauaugcaaccaaagaaucauuaccuaugaaaauagcaccuggguaaaucaaacauauguuaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuccugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaaugggccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuuuuggguugaauuaaucagaggacgaccuagagaaaagacaacaaucuggacuagugggagcagcauuucuuuuuguggcgugaauagugauacugcaaauuggucuuggccagacggugccgaguugccauucaccauugacaaguag

SEQ ID NO: 46276 - RNA, 1410 nt, Artificial Sequence
  neuraminidase__InfluenzaA__ABO38376
augaauccaaaucagaaaauaauaaccauuggaucaaucuguaugguagucggaauaauuagccuaauauugcaaauagggaauauuaucucaauauggaucagccauucaauucaaacuggaagucaaaaccauacuggaacuugcaaccaaagcaucauuaccuauaaaaauagcaccuggguaaaucaaacauauguuaauauuagcaacacuaacguuguugcuggaaaggauacaacuucagugauauuagccggcaauucaucucuuuguccuauccgugggugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagaugauggagcaguggcuguguuaaaauacaacgguauaauaacugaaaccauaaaaaguuggaggaaggaaauauugagaacacaagagucugaaugugccugcguaaaugguucauguuucacuauaaugaccgacggcccgaguggugggccggccucguacaaaauuuucaagaucgagaaggggaagguuacuaaaucaauagaauuggaugcaccuaauucucacuaugaggaauguuccuguuacccugauaccggcaaggugaugugugugugcagagacaauuggcacgguucgaaccgaccaugggugucuuucgaucaaaaucuggauuaucaaaugggcuacaucugcagugggguuuucggugacaauccgcgucccaaagauggaaaaggcaacugugguccaguguauguugauggagcaaacggaguaaagggauuuucauacagguaugguaaugguguuuggauaggaaggacuaaaaguaacaguuccagacagggguuugagaugauuugggaucccaauggguggacagagacugauaguaauuucuuugugaaacaagauguaguggcagugacugauuggucaggguacagcggaaguuucguucaacauccugaguuaacagggcuggacuguaugaggccuugcuucuggguugaauuaaucaggggacggccuaaagaaaaaacaaucuggaccagugggagcagcauuucuuuuuguggcgugaauagugauacuguagauuggucuuggccagacggugccgaguugccauucaccauugacaaguag

SEQ ID NO: 46277 - RNA, 1410 nt, Artificial Sequence
  neuraminidase__InfluenzaA__ABO38387
augaauccaaaucagaaaauaauaaccauuggaucaaucuguaugguagucggaauaauuagccuaauauugcaaauagggaauauaaucucaauauggauuagccauucaauucaaacuggaagucaaaaccauacuggaauaugcaaccaaagcaucauuaccuauaaaaauagcaccuggguaaaucaaacauauguuaauauuagcaacacuaauguuguugcuggacaggacacaacuucagugauauuaaccggcaauucaucucuuugucccauccgugggugggcuauauacagcaaagacaauggcauaagaauugguuccaaaggagacguuuuugucauaagagagccuuuuauuucauguucucacuuggaaugcaggaccuuuuuucugacccaaggcgccuuacugaaugacaagcauucaaaugggaccguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucugguccagauaaugaagcaguggcuguauuaaaauacaacggcauaauaacugaaaccauaaaaaguuggaggaagaaaauauugagaacacaagagucugaaugugccuguguaaaugguucauguuuuacuauaaugaccgauggcccgagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccaugggugucuuucgaucaaaaccuggauuaucaaauaggauacauuugcagugggguuuucggugacaauccgcgucccaaagauggaacaggcagcugugguccaguguauguugauggagcaaacggaguaaagggauuuucauauagguaugguaaugguguuuggauaggaaggaccaaaaguaccaguuccagacauggguuugagaugauuugggauccuaauggauggacagagacugauaguaaguucucugugagacaagauguuguggcaaugacugauuggucaggauauagcggaaguuucguucaacauccugagcuaacagggcuagacuguaugaggccuugcuucuggguugaauuaaucaggggacaaccuaaagaaaaaacaaucuggacuagugggagcagcauuucuuuuuguggcgugaauagugauacuguagauuggucuuggccagacggugcugaguugccauucaccauugacaaguag

SEQ ID NO: 46278 - RNA, 1413 nt, Artificial Sequence
  neuraminidase__InfluenzaA__ABO38398
augaauccaaaucagaaaauaauaaccauaggaucaaucuguauggcaauaggaauaauuagucuaauauugcaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcaggaacuuuuuucugacccaaggugcucuauuaaaugacaagcauucaaauggaaccguuaaggacagaagcccuuauagggccuuaaugagcuguccuauaggugaagcuccgucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaauggaccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugauccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 46279 - RNA, 1410 nt, Artificial Sequence
  neuraminidase__InfluenzaA__ABO38420
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauucuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacucuaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46280 - RNA, 1410 nt, Artificial Sequence
  neuraminidase__InfluenzaA__ABO38715
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagacaugccccaaaguaguggaauacagaaguuggucaaagccgcaauguaaaauuacaggauuugcaccuuuuucuaaggacaauucaauccggcuuucugcugguggggacauuugggugacgagagagccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagcgcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccaucguagacauaaauauggaagauuauagcauugauuccaguuaugugugcucagggcuuguuggcgacacaccuagaaacgacgacagaucuagcaauagcaauugcaggaauccuaauaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaaucggucagguuauucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46281 - RNA, 1410 nt, Artificial Sequence; identical to SEQ ID NO: 46280
  neuraminidase__InfluenzaA__ABO38726

SEQ ID NO: 46282 - RNA, 1413 nt, Artificial Sequence
  neuraminidase__InfluenzaA__ABO44049
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugauuuguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46283 - RNA, 1410 nt, Artificial Sequence
  neuraminidase__InfluenzaA__ABO44060
augaauccaaaucaaaagauaauaacaauuggcucugucucucucaccauugcaacaguaugcuuccucaugcagauugccauccugguaacuacuguaacauugcauuucaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagccgauacuaaaauacuauucauugaagaggggaaaauuguccauauuagcccauugucaggaagugcucagcauguagaggaguguuccuguuauccucgauacccugacgucagauguaucugcagagacaacuggaaaggcuccaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaauaggucagguuauucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuaugggacaggcucauggccugauggggcgaacaucaaucucaugccuauauaa

SEQ ID NO: 46284 - RNA, 1410 nt, Artificial Sequence
  neuraminidase__InfluenzaA__ABO44071
augaauccaaaucaaaagauaauaacaauugguuuuguuuuucucaccauugcaacaguauguuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaagaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46285 - RNA, 1410 nt, Artificial Sequence; identical to SEQ ID NO: 44899
  neuraminidase__InfluenzaA__ABO44082

SEQ ID NO: 46286 - RNA, 1410 nt, Artificial Sequence
  neuraminidase__InfluenzaA__ABO44093
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguagaauacagaaauuggucaaagccgcaaugucaaauuacaggauuugcaccuuucucuaaggacaauucaauccggcuuucugcugguggggacauuugggugacgagagaaccuuaugugucaugugauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugccacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuuuagacauaaguauggaagauuauagcauugauuccaguuaugugugcucagggcuuguuggcgacacacccaggaacgacgacagcucuagcaauagcaacugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaacuccaaaucgcaggucaauagacaggucauaguggacaacaauaauuggucugguuacucugguauuuucucuguugagggcaaaagcugcaucaauaggugcuuuuauguggaguugauaaggggaaggucacaggagacuagaguaugguggaccucaaacaguauuguuguguucuguggcacuucagguacuuauggaacaggcucauggccugauggggcgaacaucaauuucaugccuauauaa

SEQ ID NO: 46287 - RNA, 1410 nt, Artificial Sequence
  neuraminidase__InfluenzaA__ABO44104
augaauccaaaucaaaagauaauaacaauuggcucugccucucucaccauugcaacaguaugcuuccucaugcagauugccauccugguaacuacuguaacauugcauuucaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucguagacauaaauauggaagauuauagcauugauuccaguuaugugugcucagggcuuguuggagacacaccuagaaacgacgacagaucuagcaauagcaauugcagaaauccuaacaaugagaaagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauaggcaagucauaguugacagcgauaauaggucagguuauucugguauuuucucuguugagggcaaaagcugcaucaauaggugcuuuuauguggaguugauaaggggaaggaaacaggagacuagaguaugguggaccucaaacaguauuguuguguucuguggcacuucagguaccuaugggacaggcucauggccugauggggcgaacaucaaucucaugccuauauaa

SEQ ID NO: 46288 - RNA, 1413 nt, Artificial Sequence
  neuraminidase__InfluenzaA__ABO44126
augaauccaaaucagaaaauaauaaccauaggaucaaucuguauggcaauaggaauaauuagucuaauauuacaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaacggaaccguuaaggacagaagcccuuauagggccuuaaugagcuguccuauaggugaagcuccgucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguugaaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugguccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaauuacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 46289 - RNA, 1413 nt, Artificial Sequence
  neuraminidase__InfluenzaA__ABO52228
augaauccaaaucaaaaaauaauaaccauuggaucaaucaguauugcaauuggaauaauuaguuugauauugcaaauuggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaaaauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacgguucauguuuuaccauaaugaccgauggcccgaguaauggggccgcaucguacagaaucuucaaaaucgagaaggggagaguuacuaaaucaauagaguuggaugcacccaauuaucauuacgaggaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46290 - RNA, 1410 nt, Artificial Sequence
  neuraminidase__InfluenzaA__ABO52239
augaauccaaaucaaaagauaauaacaauuggcucugucucucucaccauugcaacaguaugcuucaucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaagcaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauaaaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauguagaggaguguuccuguuacccucgauauccugacgucagauguaucugcagagacaacuggaaaggcucuaauaggcccguuauagacauaaauauggaagauuauagcauugauuccaguuacgugugcucaggacuuguuggcgacacacccaggaacgacgacagcucuagcaauagcaauugcagggauccuaacaaugaaagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaaguugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46291 - RNA, 1410 nt, Artificial Sequence; identical to SEQ ID NO: 46287
  neuraminidase__InfluenzaA__ABO52250

SEQ ID NO: 46292 - RNA, 1413 nt, Artificial Sequence
  neuraminidase__InfluenzaA__ABO52261
augaauccaaaucagaaaauaauaaccauuggaucaaucuguauggcaaucggaauaauuagucuaauauugcaaauaggaaauauuauuucaauauggguuagccacucaauccaaacuggaagucaaaaccacacuggaauaugcaaccaaagaaucauuaccuacgaaaauagcaccuggguaaaucaaacauauguuaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcaugggcuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccugauggauggacagauaccgauaguaauuucuuagugaaacaggauguaguggcaaugacugauuggucaggguacagcggaaguuucguucaacauccugagcuaacaggauuggacuguauaaggccuugcuucuggguugaauuaaucagaggacgaccuagagaaaagacaacaaucuggacuagugggagcagcauuucuuuuuguggcgugaauagugauacuguaaauuggucuuggccagacggugccgaguugccauucaccauugacaaguag

SEQ ID NO: 46293 - RNA, 1413 nt, Artificial Sequence
  neuraminidase__InfluenzaA__ABO52283
augaauccaaaucagaaaauaauaaccauuggaucaaucuguaugacaaucggaacaauuagucuaauauugcaaauagggaauauuaucucaauauggauuagccacucaauucaaacuggaagucaaaaccauacuggaauaugcaaccaaagaaucauuaccuaugaaaauaacaccuggguaaaucaaacauauguuaauauuagcaacaccaacguuguugcuggaaaggacacaacuucaaugauauuagccggcaauucaucucuuuguccuauccgugggugggcuauauacagcaaagacaacagcauaaggauugguuccaaaggagauguuuuugucauaagagaaccuuuuauaucaugcucucacuuggaaugcagaaccuuuuuucugacccaaggcgcucuauuaaaugacaagcauucaaacgggaccguuaaagacagaagcccuuauagggccuuaaugagcuguccuaucggugaagcuccgucuccguacaauucaagauuugaaucgguugcuuggucagcgagugcaugucaugauggcaugggcuggcuaacuaucggaauuucugguccagaugauggagcaguggcuguauuaaaauacaauggcauaauaacugaaaucauaaaaaguuggaggaagcaaauauuaagaacacaagagucugaaugugucuguguaaacgguucauguuuuaccauaaugaccgauggcccgagugaugggccggccucguacagaaucuucaaaaucgaaaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguauggugaugguguuuggauaggaaggacuaaaaguaacaguuccagaaagggguuugagaugauuugggauccuaauggguggacagauaccgaugauaauuucuuagugaaacaggauguaguggcaaugacugauuggucaggguauagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucacaauugacauguag

SEQ ID NO: 46294 - RNA, 1410 nt, Artificial Sequence; identical to SEQ ID NO: 46022
  neuraminidase__InfluenzaA__ABO52294

SEQ ID NO: 46295 - RNA, 1410 nt, Artificial Sequence
  neuraminidase__InfluenzaA__ABO52316
augaauccaaaucaaaagauaauaacaauuggcucugucucucucaccauugcaacaauaugcuuccucaugcagauugccauccugguaacuacuguaacauugcauuucaagcaguaugagugcgacucccccgcgaacaaucaaauaaugccgugugaaccaacaauaauagaaaggaacauaacagagauaguguauuugacuaacaucaccauagaaaaagagauaugccccaaauuaguggaauacaggaauuggucaaagccgcaauguaaaauuacaggauuugcaccuuuuucuaaggacaauucaauucggcuuucugcugguggggacauuugggugacgagagaaccuuaugugucaugcgauccuagcagguguuaucaauuugcacuugggcaggggaccacacuagacaacaaacauucaaaugacacaauacaugauagaaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucucaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucagcauguagaggaguguuccuguuacccucgauauccuggugucagauguaucugcagagacaacuggaaaggcucuaauaggcccgucguagauauaaaugugaaagauuauagcauugauuccaguuaugugugcucagggcuuguuggcgacacacccagaaaaaacgacagaucuagcaauagcuauugccggaauccuaacaaugagaaagggaaucacggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuauggggcaggcucauggccugauggggcggacaucaaucucaugccuauauaa

SEQ ID NO: 46296 - RNA, 1410 nt, Artificial Sequence; identical to SEQ ID NO: 44618
  neuraminidase__InfluenzaA__ABO52327

SEQ ID NO: 46297 - RNA, 1410 nt, Artificial Sequence
  neuraminidase__InfluenzaA__ABO52338
augaauccaaaucaaaagauaauaacaauuggcucugucucucucaccauugcaacaauaugcuuccucaugcagauugccauccugguaacuacuguaacauugcauuucaagcaauaugagugcgacucccccgcgaacaaccaaguaaugccgugugaaccaauaauaauagaaaggaacauaacagagauaguguauuugacuaacaccaccauagagaaagagauaugccccaaauuaguggaauacagaaauuggucaaagccgcaauguaaaauuacaggauuugcaccuuuuucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauaggaccccucaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucaggaagagcugauacuaaaauacuauucauugaagaggggaaaauuguucauauuagcccauugucaggaagugcucaacauguagaggaguguuccuguuauccucgauauccuggugucagauguaucugcagagacaacuggaaaggcucuaauaggcccgucguagauauaaaugugaaagauuauagcauugauuccaguuaugugugcucagggcuuguuggcgacacacccagaaacaacgacagaucuagcaguagcuauugccggaauccuaacaaugagaaagggaaucauggagugaaaggcugggccuuugacgauggaaaugacguguggaugggaagaacgaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagagucugguggaccucaaacaguauuguuguguuuuguggcacuucagguaccuaugggacaggcucauggccugauggggcggacaucaaucucaugccuauauaa

SEQ ID NO: 46298 - RNA, 1410 nt, Artificial Sequence
  neuraminidase__InfluenzaA__ABO52349
augaauccaaaucaaaagauaauaacaauuggcucugucucucucaccauugcaacaauaugcuuccucaugcaaauugccauccugguaacuacuguaacauugcauuucaagcaauaugagugcgacucccccgcgaacaaccaaguaaugccgugugaaccaauaauaauagaaaggaacguaacagagauaguguauuugacuaacaccaccauagagaaagaaauaugccccaaauuaguggaauacagaaauuggucaaagccgcaauguaaaauuacaggauuugcaccuuuuucuaaggacaauucaauccgacuuucugcugguggggacauuugggugacgagagaaccuuaugugucaugcgauccuggcaaguguuaucaauuugcacucgggcaggggaccacacuagacaacaaacauucaaaugacacaauacaugauagaaccccuuaucgaacccuauugaugaaugaguuggguguuccauuucauuugggaaccaggcaaguguguauagcaugguccagcucaaguugucacgauggaaaagcauggcugcauguuugugucacuggguaugauaaaaaugcaacugcuagcuucauuuacgaugggaggcuuguagacaguauugguucauggucuaaaaauauccucaggacccaggagucggaaugcguuuguaucaaugggacuuguacaguaguaaugacugauggaagugcuucagaaagagcugacacuaaaauacuauucauugaagaggggaaaauuauucauauuagcccauugucagggagugcucagcauguagaggaguguuccuguuauccucgauauccuggugucagauguaucugcagagauaacuggaaaggcucuaauaggcccgucguagauauaaauaugagagauuauagcauuguuuccaguuaugugugcucagggcuuguuggcgacacacccagaaaaaacgacagaucuagcaguagcuauugccggaauccuaacaaugagaaagggaaucauggagugaaaggcugggccuuugaugauggaaaugacguguggaugggaagaacgaucagcgaggagucacgcucagguuaugaaaccuucaaagucauuggugguugguccacaccuaauuccaaauugcagauaaauaggcaagucauaguugacagcaauaauagguccgguuauucugguauuuucucuguugagggcaaaagcugcaucaauaggugcuuuuauguggaguugauaaggggaagggaacaggaaacuagagucugguggacaucaaacaguauuguuguguuuuguggcacuucagguaccuaugggacaggcucauggccugauggggcggacaucaaucucaugccuauauaa

SEQ ID NO: 46299 - RNA, 1410 nt, Artificial Sequence
  neuraminidase__InfluenzaA__ABO52360
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguggaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggaaaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46300 - RNA, 1410 nt, Artificial Sequence
  neuraminidase__InfluenzaA__ABO52371
augaauccaaaucaaaagauaauaacaauuggcucugucucucucaccauugcaacaguaugcuuccucaugcagauugccauccugguaacuacuguaacauugcauuucaggcaauaugagugcgacucccccgcgaacaaccaaguaaugccgugugaaccaauaauaauagaaaggaacauaacagagauaguguauuugaauaacaccaccauagagaaagaaauaugccccaaauuaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacagcuagcuucauuuaugacgggaagcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaauguggaagauuauagcauugauuccaguuaugugugcucagggcuuguuggugacacacccagaaacaacgacagaucuggcaauagcaauugcaggaauccuaacaaugagagagggaaucacggagugaaaggcugggccuuugacgauggaaaugacguguggaugggaagaacgaucaacaaggauuuacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguuaauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 46301 - RNA, 1413 nt, Artificial Sequence
  neuraminidase__InfluenzaA__ABO52800
augaauccaaaucagaaaauaauaaccauuggaucgaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaucaaacauaugucaauauuaacaacacuaacguuguugcuggaaaggacacaacuucagugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcauggguuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgaguaauggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaacuguugauggagcagacggaguaaagggguuuucauacagguaugguaaugguguuuggauaggaaggacuaaaaguaacagcuccagaaagggauuugagaugauuugggauccuaauggauggacggauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaggacaacaaucuggacuagugguagcagcauuucuuuuuguggcgugaauagugauacugcaaauuggucuuggccagacggugccgaguugccauucaccauugacaaguag

SEQ ID NO: 46302 - RNA, 1413 nt, Artificial Sequence; identical to SEQ ID NO: 45332
  neuraminidase__InfluenzaA__ABP49220

SEQ ID NO: 46303 - RNA, 1413 nt, Artificial Sequence
  neuraminidase__InfluenzaA__ABP49319
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauaacaccuggguaaaucaaacauauguuaauauuagcaacacuaacguuguugcuggaaaggacacaacuucaaugauauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuaucggugaagcuccgucuccguacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacaguuccagaaagggguuugagaugauuugggauccuaauggguggacagauaccgaugguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46304 - RNA, 1410 nt, Artificial Sequence
  neuraminidase__InfluenzaA__ABP49330
augaauccaaaucagaaaauaauaaccauuggaucaaucuguaugguagucggaauaauuagccuaauauugcaaauagggaauauuaucucaauauggauuagccauucaauucaaacuggaagucaaaaccauacuggaauaugcaaccaaagcaucauuaccuauaaaaauagcaccuggguaaaucaaacauauguuaauauuagcaacacuaacguuguugcuggaaaaggcacaacuccagugauauuagccggcaauucaucucuuuguccuauccgugggugggcuauauacagcaaagauaacggcauaagaauugguuccaaaggagauguuuuugucauaagagagccuuuuauuucauguucucacuuggaaugcaggacuuuuuuucugacccaaggcgcccuguugaaugacaagcauucaaaugggaccguuaaggacagaagcccuuauagggccuugaugagcugcccugucggugaagcuccguccccguacaauucaagguuugaaucgguugcuuggucagcaugugcaugucaugauggcaugggcuggcuaacaaucggaauuucugguccagaugaugaagcaguggcuguguuaaaauacaacggcauaauaacugaaaccauaaaaaguuggaggaagaaaauauugagaacacaagagucugaaugugucuguguaaaugguucauguuuuacuauaaugaccgacggcccgagugaugggccggccucguacaaaauuuucaagaucgagaaggggaagguuacuaaaucaauagaguuggaugcaccuaauucucacuacgaggaauguuccuguuacccugauaccggcaaggugaugugugugugcagagacaauuggcacgguucgaaccgaccaugggugucuuucgaucaaaaucuggauuaucaaauaggauacaucugcagugggguuuucggugacaauccgcgucccaaagauggaaaaggcagcugugguccgguguauguugauggagcaaacggaguaaagggauuuucauacagguaugguaaugguguuuggauaggaaggauuaaaaguaacaguuccagacagggguuugagaugauuugggauccuaauggguggacagagacugauaguaguuucuuugugaaacaagauguaguggcuaugacugauuggucaggguacagcggaaguuucguucaacauccugagcuaacagggcuggacuguaugaggccuugcuucuggguugaauuaaucaggggacgaccuaaagaaaaaacaaucuggacuagugggagcagcauuucuuuuuguggcgugaauagugauacuguagauuggucuuggccagacggugccgaauugccauucaccauugacaaguag

SEQ ID NO: 46305 - RNA, 1413 nt, Artificial Sequence
  neuraminidase__InfluenzaA__ABP49352
augaauccaaaucagaaaauaauaaccauuggaucgaucuguaugacaaucggaauaauuagucuaauauugcaaauaggaaauauuauuucaauauggguuagccacucaauccaaacuggaagucaaaaccacacuggaauaugcaaccaaagaaucauuaccuaugaaaauagcaccuggguaaaccaaacauaugucaacauuaacaacacuaacguuguugcuggaaaggacacaaccucaguggcauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggaccguuaaggacagaagcccuuauagggccuuaaugagcuguccuauaggugaagcuccgucuccauacaauucaagguuugaaucaguugcuuggucagcaagcgcaugucaugauggcauggguuggcuaacaaucggaauuucugguccagaugauggagcaguggcuguacuaaaauacaacggcauaauaacugaaaccauaaaaaguuggaggaagcgaauauuaagaacacaagagucugaaugugucuguguaaacgguucauguuuuaccauaaugaccgauggcccgagugacggaccugccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugguccaguaacuguugauggagcagacggaguaaagggguuuucauacaaguaugguaaugguguuuggauaggaaggacuaaaaguaacagcuccagaaagggauuugagaugauuugggauccuaauggauggacggauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgaccuagagaaaggacaacaaucuggacuagugguagcagcauuucuuuuuguggcguggauagugauacugcaaauugguccuggccagacggugccgagcugccauucaccauugacaaguag

SEQ ID NO: 46306 - RNA, 1413 nt, Artificial Sequence
  neuraminidase__InfluenzaA__ABP49363
augaauccaaaucagaaaauaauaaccauaggaucaaucuguauggcaauaggaauaauuagucuaauauugcaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauuggcuccaaaggggauguuuuugucauaagagaaccuuuuauaucauguucucacuuggaaugcagaaccuuuuuucugacccaaggugcucuauuaaaugacaagcauucaaacggaaccguuaaggacagaagcccuuauagggccuuaaugagcuguccuauaggugaagcuccgucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugguccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaauuacugauuggucgggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 46307 - RNA, 1410 nt, Artificial Sequence; identical to SEQ ID NO: 45247
  neuraminidase__InfluenzaA__ABP49374

SEQ ID NO: 46308 - RNA, 1413 nt, Artificial Sequence
  neuraminidase__InfluenzaA__ABP49385
augaauccaaaucaaaaaauaauaaccauuggaucaaucaguguggcaaucggaauaauuaaucuaacauugcaaauaggaaauauuauuucaauaugggcuagccacucaauccaaacuggaagucaaaacuacacuggaauaugcaaccaaagaaucauuacauaugaaaauagaaccuggguaaaucaaacauauguuaauauuaacaacacuaauguuguugcuggaaaggacaaaaccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuauccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46309 - RNA, 1413 nt, Artificial Sequence
  neuraminidase__InfluenzaA__ABP49396
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcgucgauagugauacugcaaacuggucuuggccagacggugcugaguugccguucaccauugacaaauag

SEQ ID NO: 46310 - RNA, 1410 nt, Artificial Sequence
  neuraminidase__InfluenzaA__ABP49407
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugagugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggagacuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaaucugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46311 - RNA, 1410 nt, Artificial Sequence; identical to SEQ ID NO: 45247
  neuraminidase__InfluenzaA__ABP49418

SEQ ID NO: 46312 - RNA, 1410 nt, Artificial Sequence
  neuraminidase__InfluenzaA__ABP49429
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguauggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46313 - RNA, 1410 nt, Artificial Sequence
  neuraminidase__InfluenzaA__ABP49440
augaauccaaaucaaaagauaauaacaauuggcucugucucucucaccauugcaacaguaugcuuccucauucagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucacaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggccaauagacaggucauaguugacaaaaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46314 - RNA, 1413 nt, Artificial Sequence; identical to SEQ ID NO: 46250
  neuraminidase__InfluenzaA__ABP49451

SEQ ID NO: 46315 - RNA, 1410 nt, Artificial Sequence
  neuraminidase__InfluenzaA__ABP49462
augaauccaaaucaaaagauaauaacaauuggcucugucucucucaccauugcaacaguaugcuucaucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaagcaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46316 - RNA, 1410 nt, Artificial Sequence
  neuraminidase__InfluenzaA__ABP49473
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaccaauuugcacucgggcaggggaccacacuagacaacaaacauucaaauggcacaauacaugauagaaucccucaccgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46317 - RNA, 1410 nt, Artificial Sequence
  neuraminidase__InfluenzaA__ABP49495
augaauccaaaucaaaagauaauaacaauuggcucugucucucucaccauugcaacaauaugcuuccucaugcagauugccauccugguaaccacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggagaggcucuaauaggccagucguagauauaaaugugaaagauuauagcauugauuccaguuaugugugcucagggcuugugggcgacacacccagaaacaacgacagaucuagcaguagcuauugccggaauccuaacaaugaaaaagggacucacggagugaaaggcugggccuuugacgauggaaaugacguguggaugggaagaacaaucagcgaggauucacgcucagguuaugaaaccuucaaagucauuggugguugguccacaccuaauuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucagguaccuaugggacaggcucauggccugauggggcggacaucaaucucaugccuauauaa

SEQ ID NO: 46318 - RNA, 1410 nt, Artificial Sequence
  neuraminidase__InfluenzaA__ABP49506
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacucuauuaaugaaugaguuggguguuccauuucauuuaggaaccagacaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaauggaaccugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46319 - RNA, 1410 nt, Artificial Sequence; identical to SEQ ID NO: 44599
  neuraminidase__InfluenzaA__ABP49517

SEQ ID NO: 46320 - RNA, 1413 nt, Artificial Sequence
  neuraminidase__InfluenzaA__ABQ01314
augaauccaaaucagaaaauaauaaccauuggaucaaucuguauggcaaucggaacaauuagucuaauauugcaaauagggaauauuaucucaauauggguuagccacucaauucaaacuggaagucaaaaccauacuggaauaugcaaccaaagaaucauuaccuaugaaaauaacaccuggguaaaucaaacauauguuaauauuagcaacacuaauguuguugcuggaaaggacacaacuucaaugauauuagccggcaauucaucucuuuguccuauccgugggugggcuauauacagcaaagacaacagcauaagaauugguuccaaaggagauguuuuugucauaagagaaccuuuuauaucaugcucucacuuggaaugcagaaccuuuuuccugacccaaggcgcucuauuaaaugacaagcauucaaaugggaccguuaaagacagaagcccuuauagggccuuaaugagcuguccuaucggugaagcuccgucuccguacaauucaagauuugaaucgguugcuuggucagcgagugcaugucaugauggcaugggcuggcuaacuaucggaauuucugguccagaugauggagcaguggcuguauuaaaauacaacggcauaauaacugaaaucauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacaguuccagaaagggguuugagaugauuugggauccuaauggguggacagauaccgaugguaauuucuuagugaaacaggauguaguggcaaugacugauuggucaggguauagcggaaguuucguucaacauccugagcuaacaggauuggacuguaugaggccuuguuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46321 - RNA, 1413 nt, Artificial Sequence
  neuraminidase__InfluenzaA__ABQ01325
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacaggagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggcaggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugcugaguugccauucaccauugacaaguag

SEQ ID NO: 46322 - RNA, 1410 nt, Artificial Sequence
  neuraminidase__InfluenzaA__ABQ01336
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuauggaccucaaacaguauuguuguguuuuguggcaccucagguacauauggaacaggcucauggccugauggggcggacaucaaucucaugccuauauaa

SEQ ID NO: 46323 - RNA, 1410 nt, Artificial Sequence; identical to SEQ ID NO: 45247
  neuraminidase__InfluenzaA__ABQ01347

SEQ ID NO: 46324 - RNA, 1410 nt, Artificial Sequence
  neuraminidase__InfluenzaA__ABQ01358
augaauccaaaucaaaagauaauaacaauuggcucugucucucucaccauugcaacaguaugcuuccucaugcagauugccauccuggcaacuacugugacauugcauuuuaagcaacaugagugcaacucccccgcgagcaaccaaguaaugccaugugaaccaauaauaauagaaaggaacauaacagagauaguguauuugaauaacaccaccauagaaaaagagauuugccccgaaguaguagaauacagaaauuggucaaagccgcaaugucaaauuacaggauuugcaccuuucucuaaggacaauucaauccggcuuucugcugguggggacauuugggugacgagagaaccuuaugugucaugugauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugccacgauggaaaagcaugguugcauguuugugucacuggggaugauagaaaugcaacugcuagcuucauuuaugacgggaggcuugaggacaguauugguucauggucucaaaauauccucaggacccaggagucggaaugcguuuguaucaaugggacuugcacaguaguaaugacugauggaaaugcaucgggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuuuagacauaaguauggaagauuauagcauugauuccaguuaugugugcucagggcuuguuggcgacacacccaggaacgacgacagcucuagcaauagcaacugcagggauccuaacaaugagagagggaauccgggagugaaaggcugggccuuugacaauggagaugauguauggaugggaagaacaaucagcaaagauuuacgcucagguuaugaaacuuucaaagucauuggugguugguccacaccuaacuccaaaucgcaggucaauagacaggucauaguagacaacaauaauuggucugguuacucugguauuuucucuguugagggcaaaagcugcaucaauaggugcuuuuauguggaguugauaaggggaaggucacaggagacuagaguaugguggaccucaaacaguauuguuguguucuguggcacuucagguacuuauggaacaggcucauggccugauggggcgaacaucaauuucaugccuauauaa

SEQ ID NO: 46325 - RNA, 1410 nt, Artificial Sequence
  neuraminidase__InfluenzaA__ABQ01369
augaauccaaaucaaaagauaauaacaauuggcucugucucucucaccauugcaacaauaugcuucgucaugcagauugccauccugguaacuacuguaacauugcauuucaagcaauaugagugcgacuccccagcgaacaaccaaguaaugccgugugaaccaauaauaauagaaaggaacauaacagagauaguguauuugacuaacaccaccauagaaaaagagauaugccccaaauuaguggaauacaggaauuggucaaagccacaauguaaaauuacaggauuugcaccuuucucuaaggacaauucaauucggcuuucugcugguggggacauuugggugacgagagaaccuuaugugucaugcgauccuggcaaguguuaucaauuugcacucgggcaggggaccacacuagacaacaaacauucaaaugacacaauacaugauagaaccccucaucgaacccuauugaugaaugaguuggguguuccauuucacuugggaaccaggcaaguguguauagcaugguccagcucaaguugucacgauggaaaagcauggcugcauguuugugucacuggguaugauaaaaaugcaacugcuagcuucauuuacgaugggaggcuuguagacagcauugguucauggucucaaaauauccucaggacccaggagucggaauguguuuguaucaaugggacuuguacaguaguaaugacugauggaagugcuucaggaagagcugauacuaaaauacuauucauugaagaggggaaaauuguucauacuagcccauugucaggaagugcucagcauguagaggaguguuccuguuauccucgauauccuggugucagauguaucugcagagacaacuggaaaggcucuaauaggccagucguagauauaaaugugaaagauuauagcauugauuccaguuaugugugcucagggcuugugggcgacacacccagaaaaaacgacagaucuagcaguagcuauugccggaauccuaacaaugaaaaagggacucacggagugaaaggcugggccuuugacgauggaaaugacguguggaugggaagaacgaucagcgaggauucacgcucagguuaugaaaccuucaaagucauuggugguugguccacaccuaacuccaaauugcagauaaauaggcaagucauaguugacagcgauaauaggucagguuauucugguauuuucucuguugagggcaaaagcugcaucaauaggugcuuuuauguggaguugauaaggggaagggaacaggaaacuagaguaugguggaccucaaacaguauuguuguguuuuguggcacuucggguaccuauggaacaggcucauggccugauggggcggacaucaaucucaugccuauauaa

SEQ ID NO: 46326 - RNA, 1410 nt, Artificial Sequence
  neuraminidase__InfluenzaA__ABQ44386
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaaaugaagucuuguggaccucaaacaguauuguuguguuuuguggcaccucagguacauauggaacaggcucauggccugauggggcggacaucaaucucaugccuauauaa

SEQ ID NO: 46327 - RNA, 1410 nt, Artificial Sequence; identical to SEQ ID NO: 45893
  neuraminidase__InfluenzaA__ABQ44408

SEQ ID NO: 46328 - RNA, 1413 nt, Artificial Sequence
  neuraminidase__InfluenzaA__ABQ44419
augaauccaaaucagaaaauaauaaccauaggaucaaucuguauggcaauaggaauaauuagucuaauauugcaaauaggaaauauuguuucaauauggaucagccacucaauccaaaauggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaacggaaccguuaaggacagaagcccuuauagggccuuaaugagcuguccuauaggugaagcuccaucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgaccuugggugucuuuuaaucaaaaccuggauuaucaaauaggauacaucugcagugguguuuuuggugacaauccgcgucccaaagauggaaaaggcagcugugguccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggagugaauggugauacugcaaauuggucuuggccagacggugccgaguugccauucaccauugacaaguag

SEQ ID NO: 46329 - RNA, 1410 nt, Artificial Sequence; identical to SEQ ID NO: 44850
  neuraminidase__InfluenzaA__ABQ44430

SEQ ID NO: 46330 - RNA, 1410 nt, Artificial Sequence; identical to SEQ ID NO: 46280
  neuraminidase__InfluenzaA__ABQ44441

SEQ ID NO: 46331 - RNA, 1410 nt, Artificial Sequence; identical to SEQ ID NO: 46264
  neuraminidase__InfluenzaA__ABQ44463

SEQ ID NO: 46332 - RNA, 1413 nt, Artificial Sequence
  neuraminidase__InfluenzaA__ABQ44474
augaauccaaaucagaaaauaauaaccauuggaucaaucuguaugacaaucggaacaauuagucuaauauugcaaauagggaauauuaucucaauauggguuagccacucaauucaaacuggaagucaaaaccauacuggaauaugcaaccaaagaaucauuaccuaugaaaauaacaccuggguaaaucaaacauauguuaauauuagcaacacuaauguuguugcuggaaaggacacaacgucaaugauauuagccggcaauucaucucuuuguccuauccgugggugggcuauauacagcaaagacaacagcauaagaauugguuccaaaggagauguuuuugucauaagagaaccuuuuauaucaugcucucacuuggaaugcagaaccuuuuuucugacccaaggcgcucuauuaaaugacaagcauucaaaugggaccguuaaagacagaagcccuuauagggccuuaaugagcuguccuaucggugaagcuccgucuccguacaauucaagauuugaaucgguugcuuggucagcgagugcaugucaugauggcaugggcuggcuaacuaucggaauuucugguccagaugauggagcaguggcuguauuaaaauacaacggcauaauaacugaaaucauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacaguuccagaaagggguuugagaugauuugggauccuaauggguggacagauaccgaugguaauuucuuagugaaacaggauguaguggcaaugacugauuggucaggguauagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauucaccauugacaaguag

SEQ ID NO: 46333 - RNA, 1410 nt, Artificial Sequence; identical to SEQ ID NO: 44599
  neuraminidase__InfluenzaA__ABR15800

SEQ ID NO: 46334 - RNA, 1413 nt, Artificial Sequence
  neuraminidase__InfluenzaA__ABR15811
augaauccaaaucagaaaauaauaaccauuggaucaaucuguauggcaaucggaacaauuagucuaauauugcaaauagggaauauuaucucaauauggguuagccacucaauucaaacuggaagucaaaaccauacuggaauaugcaaccaaagaaucauuaccuaugaaaauaacaccuggguaaaucaaacauauguuaauauuagcaacacuaauguuguugcuggaaaggacacaacuucaaugauauuagccggcaauucaucucuuuguccuauccgugggugggcuauauacagcaaagacaacagcauaagaauugguuccaaaggagauguuuuugucauaagagaaccuuuuauaucaugcucucacuuggaaugcagaaccuuuuuucugacccaaggcgcucuauuaaaugacaagcauucaaaugggaccguuaaagacagaagcccuuauagggccuuaaugagcuguccuaucggugaagcuccgucuccguacaauucaagauuugaaucgguugcuuggucagcgagugcaugucaugauggcaugggcuggcuaacuaucggaauuucugguccagaugauggagcaguggcuguauuaaaauacaacggcauaauaacugaaaucauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcaccuaauucucauuacgaggaauguuccuguuacccagacaccggcaaagugaugugugugugcagagacaauuggcaugguucgaaucgaccaugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacaguuccagaaagggguuugagaugauuugggauccuaauggguggacagauaccgaugguaauuucuuagugaaacaggauguaguggcaaugacugauuggucaggguauagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugcccuucaccauugacaaguag

SEQ ID NO: 46335 - RNA, 1413 nt, Artificial Sequence; identical to SEQ ID NO: 45383
  neuraminidase__InfluenzaA__ABR15910

SEQ ID NO: 46336 - RNA, 1410 nt, Artificial Sequence; identical to SEQ ID NO: 45705
  neuraminidase__InfluenzaA__ABR15932

SEQ ID NO: 46337 - RNA, 1410 nt, Artificial Sequence
  neuraminidase__InfluenzaA__ABR15943
augaauccaaaucaaaagauaauaacaauuggcucuguuucucucaccauugccacaauaugcuuccuuaugcaaauugccauccugguaacuacuguaacauugcauuucaggcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgguauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46338 - RNA, 1410 nt, Artificial Sequence
  neuraminidase__InfluenzaA__ABR15954
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugugauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacaacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46339 - RNA, 1410 nt, Artificial Sequence; identical to SEQ ID NO: 44686
  neuraminidase__InfluenzaA__ABR15965

SEQ ID NO: 46340 - RNA, 1410 nt, Artificial Sequence
  neuraminidase__InfluenzaA__ABR22243
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaccgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggaccucaaucucaugccuauauaa

SEQ ID NO: 46341 - RNA, 1410 nt, Artificial Sequence
  neuraminidase__InfluenzaA__ABR28518
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcagcagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46342 - RNA, 1410 nt, Artificial Sequence; identical to SEQ ID NO: 45080
  neuraminidase__InfluenzaA__ABR28595

SEQ ID NO: 46343 - RNA, 1413 nt, Artificial Sequence
  neuraminidase__InfluenzaA__ABR28771
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaagagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46344 - RNA, 1413 nt, Artificial Sequence
  neuraminidase__InfluenzaA__ABR28782
augaauccaaaucaaaaaauaauaaccauuggaucaaucaguauagcaaucggaauacuuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46345 - RNA, 1410 nt, Artificial Sequence; identical to SEQ ID NO: 45348
  neuraminidase__InfluenzaA__ABR28793

SEQ ID NO: 46346 - RNA, 1413 nt, Artificial Sequence; identical to SEQ ID NO: 45381
  neuraminidase__InfluenzaA__ABR28804

SEQ ID NO: 46347 - RNA, 1410 nt, Artificial Sequence; identical to SEQ ID NO: 45247
  neuraminidase__InfluenzaA__ABR28815

SEQ ID NO: 46348 - RNA, 1410 nt, Artificial Sequence; identical to SEQ ID NO: 45705
  neuraminidase__InfluenzaA__ABR28826

SEQ ID NO: 46349 - RNA, 1413 nt, Artificial Sequence
  neuraminidase__InfluenzaA__ABR28837
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucccuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgaugguccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 46350 - RNA, 1413 nt, Artificial Sequence
  neuraminidase__InfluenzaA__ABR28848
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauuguuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgccucguacaaaaucuucaagaucgaaaagggaaagauuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugguuugggauccuaauggauggacagauaccgacagugauuucucagugaaacaggauguuguggcaauaacugauuggucuggguacagcggaaguuucguucaacauccugaguuaacaggauugaacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 46351 - RNA, 1410 nt, Artificial Sequence
  neuraminidase__InfluenzaA__ABR28859
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaacccuaugugucaugcgauccugacaaguguuaucaauuugcccuugggcagggaacaacacuaaacaacgggcauucaaaugacacaguacaugguaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46352 - RNA, 1410 nt, Artificial Sequence
  neuraminidase__InfluenzaA__ABR28870
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagacaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46353 - RNA, 1410 nt, Artificial Sequence
  neuraminidase__InfluenzaA__ABR28881
augaauccaaaucaaaagauaauaacaauuggcucuguuucucucaccauugccacaguaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46354 - RNA, 1410 nt, Artificial Sequence; identical to SEQ ID NO: 45893
  neuraminidase__InfluenzaA__ABR28892

SEQ ID NO: 46355 - RNA, 1413 nt, Artificial Sequence
  neuraminidase__InfluenzaA__ABR28903
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcucuaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcggauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46356 - RNA, 1410 nt, Artificial Sequence
  neuraminidase__InfluenzaA__ABR28925
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacagugcaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaguccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuacagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauuacagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46357 - RNA, 1410 nt, Artificial Sequence
  neuraminidase__InfluenzaA__ABR88082
auggauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaucauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 46358 - RNA, 1413 nt, Artificial Sequence
  neuraminidase__InfluenzaA__ABS00324
augaauccaaaucagaaaauaauaaccauaggaucaaucuguauggcaauaggaauaauuagucuaauauugcaaauaggaaauauuguuucaauauggaucagccacucaauccaaacuggaagucaaaacuacacuggaauaugcaaccaaagaaucauuaccuaugaaaauagcaccuggguaaaucaaacauauguuaauaucaacaacacuaauguuguugcuggacaggacacaacuucaguggcauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaauggaaccguuaaggacagaagcccuuauagggccuuaaugagcuguccuauaggugaagcuccgucucccuacaauucaagguuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcgugguucgaaucgaccuugggugucuuuuaaucaaagccuggauuaucaaauaggauacaucugcagugguguuuuuggugacaauccgcgucccaaagauggaaaaggcagcugugauccaguaacuguugauggagcagacggaguaaagggguuuucauacagguaugguaaugguguuuggauaggaaggacuaaaaguaacagcuccagaagaggauuugagaugauuugggauccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggcgugaauggugauacugcaaauuggucuuggccagacgguuccgaguugccauucaccauugacaaguag

SEQ ID NO: 46359 - RNA, 1410 nt, Artificial Sequence; identical to SEQ ID NO: 44618
  neuraminidase__InfluenzaA__ABS49902

SEQ ID NO: 46360 - RNA, 1410 nt, Artificial Sequence
  neuraminidase__InfluenzaA__ABS49913
augaauccaaaucaaaagauaauaacaauuggcucugucucucucaccauugcaacaguaugcuuccucaugcagauugccauccugguaacuacuguaacauugcauuucaggcaauaugagugcgacucccccacgaacaaccaaguaaugccgugugaaccaauaauaauagaaaggaacauaacagagauaguguauuugaauaacaccaccauagagaaagagauaugccccaaauuaguggaauacagaaauuggucaaagccgcaauguaaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauugaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuuguacaguaguaaugacugauggaagugcuucaggaagagcugauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagauauaaauguggaagauuauagcauugauuccaguuaugugugcucagggcuuguuggcgacacacccagaaacaacgacagaucuagcaauagcaauugcaggaauccuaacaaugagagagggaaucacggagugaaaggcugggccuuugacgauggaaaugacguguggaugggaagaacgaucagcaaggauuuacgcucagguuaugaaaccuucaaagucauuggugguugguccacaccuaauuccaaaucgcagauaaauaggcaagucauaguugacagcgauaauaggucagguuauucugguauuuucucuguugagggcaaaagcugcaucaauaggugcuuuuauguggaguuaauaaggggaagggaacaggagacuagaguaugguggaccucaaacaguauuguuguguuuuguggcacuucagguaccuaugggacaggcucauggccugauggggcggacaucaaucucaugccuauauaa

SEQ ID NO: 46361 - RNA, 1410 nt, Artificial Sequence; identical to SEQ ID NO: 45348
  neuraminidase__InfluenzaA__ABS49968

SEQ ID NO: 46362 - RNA, 1413 nt, Artificial Sequence; identical to SEQ ID NO: 46344
  neuraminidase__InfluenzaA__ABS49979

SEQ ID NO: 46363 - RNA, 1413 nt, Artificial Sequence
  neuraminidase__InfluenzaA__ABS49990
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugauauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46364 - RNA, 1410 nt, Artificial Sequence; identical to SEQ ID NO: 45247
  neuraminidase__InfluenzaA__ABS50001

SEQ ID NO: 46365 - RNA, 1410 nt, Artificial Sequence
  neuraminidase__InfluenzaA__ABS50012
augaauccaaaucaaaagauaauaacgauuggcucuguuucucucaccauugccacaauaugcuuccuuaugcaaauugccauccugguaacuacuguaacguugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguaucgguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacgcccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaagcaaaagcugcaucaauaggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46366 - RNA, 1410 nt, Artificial Sequence
  neuraminidase__InfluenzaA__ABS50023
augaauccaaaucaaaagauaauaacgauuggcucuguuucucucaccauugccacaauaugcuuccuuaugcaaauugccguccugguaacuacuguaacauugcauuucaagcaauaugaaugcaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacauaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46367 - RNA, 1410 nt, Artificial Sequence; identical to SEQ ID NO: 45247
  neuraminidase__InfluenzaA__ABS50034

SEQ ID NO: 46368 - RNA, 1410 nt, Artificial Sequence
  neuraminidase__InfluenzaA__ABS50045
augaauccaaaucaaaagauaauaacaauuggcucuguuucucucaccauugccacaauaugcuuccuuaugcaaacugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaauacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46369 - RNA, 1410 nt, Artificial Sequence
  neuraminidase__InfluenzaA__ABS50056
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucaggacccaggagucggaaugcguuuguaucaauggaacuuguacaguaguaaugacugaugggagcgcuucagggaaagccgauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46370 - RNA, 1410 nt, Artificial Sequence
  neuraminidase__InfluenzaA__ABS50067
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggaucauagcauuguuuccaguuaugugugcucaggacuuguuggagacacacccagaaaaaacgacagcuucagcaguagccauugccuagacccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacaggucugguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46371 - RNA, 1410 nt, Artificial Sequence; identical to SEQ ID NO: 45893
  neuraminidase__InfluenzaA__ABS50078

SEQ ID NO: 46372 - RNA, 1413 nt, Artificial Sequence
  neuraminidase__InfluenzaA__ABS71644
augaaaccaaaucaaaaaauaauaaccauuggaucaaucaguauagcaaucggaauaauuagucuaauauugcaaauaggaaauauuauuucaauaugggcuagucacucaauccaaacugaaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauggaguugaaugcacccaauuuucauuaugaggaauguuccuguuacccagacacuggcacaguaauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggaugggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcuaccuagggaaaauacaacaaucuggacuagugggagcagcauuucuuuuuguggcguuaauagugguacugcaaacuggucuuggccagacggugcugaguugccguucaccauugacaaguag

SEQ ID NO: 46373 - RNA, 1413 nt, Artificial Sequence
  neuraminidase__InfluenzaA__ABS71646
augaacccaaaucaaaaaauaauaaccauuggaucaaucaguauagcaaucggaauaauuagucuaauauugcaaauaggaaauauuauuucaauaugggcuagucacucaauccaaacugaaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauggaguugaaugcacccaauuuucauuaugaggaauguuccuguuacccagacacuggcacaguaauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggaugggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcuaccuagggaaaauacaacaaucuggacuagugggagcagcauuucuuuuuguggcguuaauagugguacugcaaacuggucuuggccagacggugcugaguugccguucaccauugacaaguag

SEQ ID NO: 46374 - RNA, 1413 nt, Artificial Sequence
  neuraminidase__InfluenzaA__ABS71647
augaacccaaaucaaaaaauaauaaccauuggaucaaucaguauagcaaucggaauaauuagucuaauauugcaaauaggaaauauuauuucaauaugggcuagucacucaauccaaacugaaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggagaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauggaguugaaugcacccaauuuucauuaugaggaauguuccugcuacccagacacuggcacaguaauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacgggguaaaaggguuuucauacaaauaugguaaugguguuuggaugggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcuaccuagggaaaauacaacaaucuggacuagugggagcagcauuucuuuuuguggcguuaauaguggugcugcaaacuggucuuggccagacggugcugaguugccguucaccauugacaaguag

SEQ ID NO: 46375 - RNA, 1413 nt, Artificial Sequence
  neuraminidase__InfluenzaA__ABS71648
augaacccaaaucaaaaaauaauaaccauuggaucaaucaguauagcaaucggaauaauuagucuaauauugcaaauaggaaauauuauuucaauaugggcuagucacucaauccaaacuggaaaucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuaaggaaaauacaacaaucuggacuagugggagcagcauuucuuuuuguggcguuaauagugguacugcaaacuggucuuggccagacggugcugaguugccguucaccauugacaaguag

SEQ ID NO: 46376 - RNA, 1413 nt, Artificial Sequence
  neuraminidase__InfluenzaA__ABS71649
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcuuggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauagggccgcuucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 46377 - RNA, 1413 nt, Artificial Sequence
  neuraminidase__InfluenzaA__ABS71651
augaacccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccagagaaucaucacauaugaaaacaacaccugggugaaucacacauauguuaauauuaacaacacuaauguuguugcuggaaaggacaaaacuucagugacauuggccggcaauucaucucuuuguucugucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaagucccuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcgaauauuaagaacacaagagucugaaugugucuguaugaacgggucauguuucaccauaaugaccgauggcccuaguaauggggccgccucguacaaaauuuucaagauugagaaggggaaaguuacuaaaucaauagaguugaaugcacccaguuuucauuaugaggaauguuccuguuacccagacacuggcacagugauguguguaugcagggacaacuggcaugguucaaaucgaccuuggguaucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuugguuagggaggaccaaaaguaacagacuuagaaagggguuugagaugauuugggauccuaauggauggacaaauaccgacagugauuucucagugaaacaggauguuguagcaauaacugauuggucgggguacaguggaaguuucguucaacauccugaguuaacaggauuggacuguauaagaccuugcuucuggguugaguuagucagagggcuuccuagagaaaauacaacaaucuggacuagugggagcagcauuucuuuuuguggcguuaauaguaauacugcaaacuggucuuggccagacggugcugaguugccguucaccauugacaaguag

SEQ ID NO: 46378 - RNA, 1413 nt, Artificial Sequence
  neuraminidase__InfluenzaA__ABS71652
augaacccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccagagaaucaucacauaugaaaacaacaccugggugaaucacacauauguuaauauuaacaacacuaauguuguugcuggaaaggacaaaacuucagugacauuggccggcaauucaucucuuuguucugucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaagucccuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccuaguaauggggccgccucguacaaaauuuucaagauugagaaggggaaaguuacuaaaucaauagaguugaaugcacccaguuuucauuaugaggaauguuccuguuacccagacacuggcacagugauguguguaugcagggauaacuggcaugguucaaaucgaccuuggguaucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucgggguacaguggaaguuucguucaacauccugaguuaacaggauuggacuguauaagaccuugcuucuggguugaguuagucagagggcuuccuagagaaaauacaacaaucuggacuagugggagcagcauuucuuuuuguggcguuaauaguaauacugcaaacuggucuuggccagacggugcugaguugccguucaccauugacaaguag

SEQ ID NO: 46379 - RNA, 1413 nt, Artificial Sequence
  neuraminidase__InfluenzaA__ABS71653
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugaucuguccucuaggugaagcuccguccccauacaauucaaaguuugaaucaguugcauggucagcaagugcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaagagaguuaaaugcacccaauuuucauuaugaggaauguuccuguuacccggacauuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacugcugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuaguggaagcagcauuucuuuuuguggcguugauagugauacugcaaacuggucuuggccagacggugcugaguugccguucaccauugacaaguaa

SEQ ID NO: 46380 - RNA, 1410 nt, Artificial Sequence
  neuraminidase__InfluenzaA__ABS71655
augaauccaaucaaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagugagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 46381 - RNA, 1410 nt, Artificial Sequence
  neuraminidase__InfluenzaA__ABS71657
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaauggaaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacgcguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 46382 - RNA, 1410 nt, Artificial Sequence
  neuraminidase__InfluenzaA__ABS71659
augaauccaaucaaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcgacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggacuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucggcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucacaugccuauauaa

SEQ ID NO: 46383 - RNA, 1410 nt, Artificial Sequence
  neuraminidase__InfluenzaA__ABS71660
augaauccaaucaaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 46384 - RNA, 1410 nt, Artificial Sequence
  neuraminidase__InfluenzaA__ABS71661
auguauccaaucaaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggacuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauag

SEQ ID NO: 46385 - RNA, 1410 nt, Artificial Sequence
  neuraminidase__InfluenzaA__ABS71662
augaauccaaucaaaaagauaauaacgauuggcucuguuucccucaccauuuccacaauaugcuucuucaugcaaauugcuaucuugauaacuacuguaacauugcauuucaagcaauaugaguucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaaguucaaguugucacgauggaaaagcauggcugcauguuuguauaacgggggaugauaaaaaugcaacugcuagcuucauuuauaaugggaggcuuguagauaguauuguuucaugguccaaagaaauccucaggacccaggagucagaaugcguuuguaucaauggaacuuguacaguaguaaugacugaugggagugcuucagggaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46386 - RNA, 1410 nt, Artificial Sequence
  neuraminidase__InfluenzaA__ABS71663
auguauccaaucaaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuauaggacccuauugaugaaugaguuagguguuccuuuucaucuggggaccaagcaagugugcauagcauggucaagcucaaguugucacgauggaaaagcauggcugcauguuuguauaacgggggaugaucaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgaucagcgagaagucacgcuuaggauaugaaaccuucaaagucauugaaggcugguccaacccuaauuccaaauugcagaugaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46387 - RNA, 1410 nt, Artificial Sequence
  neuraminidase__InfluenzaA__ABU40956
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaauuguuaucaauuugcccuuggacagggaacaacacuaaacaacgugcauucaaaugacacaguacgugauaggaccccuuaccggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcuccugcuauccucgauauccuggugucagaugugucugcagagacaacuggaaaggcuccaauaggcccaucauagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46388 - RNA, 1410 nt, Artificial Sequence
  neuraminidase__InfluenzaA__ABU50651
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugagaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46389 - RNA, 1410 nt, Artificial Sequence
  neuraminidase__InfluenzaA__ABU80180
augaauccaaaucaaaagauaauaacgauuggcucuguuucucucaccauugccacaauaugcuuccuuaugcaaauugccauccugguaacuacuguaacauugcauuucaagcaauaugaaugcaacuccuucccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46390 - RNA, 1413 nt, Artificial Sequence; identical to SEQ ID NO: 45381
  neuraminidase__InfluenzaA__ABU80301

SEQ ID NO: 46391 - RNA, 1413 nt, Artificial Sequence
  neuraminidase__InfluenzaA__ABU80312
augaauacaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucaugagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46392 - RNA, 1410 nt, Artificial Sequence; identical to SEQ ID NO: 45247
  neuraminidase__InfluenzaA__ABU80323

SEQ ID NO: 46393 - RNA, 1410 nt, Artificial Sequence
  neuraminidase__InfluenzaA__ABU80334
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaacacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauacggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46394 - RNA, 1410 nt, Artificial Sequence
  neuraminidase__InfluenzaA__ABU92762
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgagggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46395 - RNA, 1410 nt, Artificial Sequence
  neuraminidase__InfluenzaA__ABU92764
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauggaaagaaacauaacagagauaguguaucugaccaacaccaccauagagaaggaaauaugccccaaacuagcagaauacagaaauuggucaaagccgcaauguaacguuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaagaaagaggaaacugaagucugguggaccucaaacaguauuguuguguuuuguggcaccucagguacauauggaacaggcucauggccugauggggcggauaucaaucucaugccuauauaa

SEQ ID NO: 46396 - RNA, 1410 nt, Artificial Sequence
  neuraminidase__InfluenzaA__ABU92765
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46397 - RNA, 1410 nt, Artificial Sequence; identical to SEQ ID NO: 45670
  neuraminidase__InfluenzaA__ABU92766

SEQ ID NO: 46398 - RNA, 1410 nt, Artificial Sequence; identical to SEQ ID NO: 45670
  neuraminidase__InfluenzaA__ABU92767

SEQ ID NO: 46399 - RNA, 1410 nt, Artificial Sequence
  neuraminidase__InfluenzaA__ABU92768
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46400 - RNA, 1410 nt, Artificial Sequence
  neuraminidase__InfluenzaA__ABU92769
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaaugggacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46401 - RNA, 1410 nt, Artificial Sequence
  neuraminidase__InfluenzaA__ABU92770
augaauccaaaucaaaagauaauaacgauuggcucuguuucucucaccauugccacaaucugcuuccuuaugcaaauugccauccuaguaacuacuguaacauugcauuucaagcaauaugaaugcaacucccccccaaacaaccaagugaugcugugugaaccaacaauaauagaaagaaacauaacagagauaguauaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagauccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46402 - RNA, 1410 nt, Artificial Sequence
  neuraminidase__InfluenzaA__ABU92771
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccuaacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaacagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46403 - RNA, 1410 nt, Artificial Sequence
  neuraminidase__InfluenzaA__ABU92772
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46404 - RNA, 1410 nt, Artificial Sequence
  neuraminidase__InfluenzaA__ABU92773
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagacaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46405 - RNA, 1410 nt, Artificial Sequence
  neuraminidase__InfluenzaA__ABU92774
augaauccaaaucgaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagacaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagacaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46406 - RNA, 1410 nt, Artificial Sequence
  neuraminidase__InfluenzaA__ABU92775
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauuguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagauguguaugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46407 - RNA, 1410 nt, Artificial Sequence
  neuraminidase__InfluenzaA__ABU92777
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucacacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggagcugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46408 - RNA, 1410 nt, Artificial Sequence
  neuraminidase__InfluenzaA__ABU92778
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaguaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgaaaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 46409 - RNA, 1410 nt, Artificial Sequence
  neuraminidase__InfluenzaA__ABU92779
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46410 - RNA, 1410 nt, Artificial Sequence
  neuraminidase__InfluenzaA__ABU92780
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugauaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacucaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacucguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46411 - RNA, 1410 nt, Artificial Sequence
  neuraminidase__InfluenzaA__ABU92781
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagaucccaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46412 - RNA, 1410 nt, Artificial Sequence
  neuraminidase__InfluenzaA__ABU92782
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggagagaggaaacugaagucugguggaccucaaacaguauuguuguguuuuguggcaccucagguacauauggaacaggcucauggccugauggggcggauaucaaucucaugccuauauaa

SEQ ID NO: 46413 - RNA, 1410 nt, Artificial Sequence; identical to SEQ ID NO: 46409
  neuraminidase__InfluenzaA__ABU92783

SEQ ID NO: 46414 - RNA, 1410 nt, Artificial Sequence; identical to SEQ ID NO: 45276
  neuraminidase__InfluenzaA__ABU92784

SEQ ID NO: 46415 - RNA, 1410 nt, Artificial Sequence; identical to SEQ ID NO: 45276
  neuraminidase__InfluenzaA__ABU92785

SEQ ID NO: 46416 - RNA, 1410 nt, Artificial Sequence
  neuraminidase__InfluenzaA__ABU92786
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacucaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46417 - RNA, 1410 nt, Artificial Sequence
  neuraminidase__InfluenzaA__ABU92787
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgacauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46418 - RNA, 1410 nt, Artificial Sequence
  neuraminidase__InfluenzaA__ABU92789
augaauccaaaucaaaagauaauaacgauuggcucuguuucucucaccauuuccacaauaugcuucuucaugcaaauugccaucuugauaacuacuguaacauugcauuucaagcaauaugaauucaacccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguagcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaaguaugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagacauaaacauaaaggauuauagcauuguuuccaguuaugugugcucgggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46419 - RNA, 1410 nt, Artificial Sequence
  neuraminidase__InfluenzaA__ABU92790
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucacacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucgggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46420 - RNA, 1410 nt, Artificial Sequence
  neuraminidase__InfluenzaA__ABU92791
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcacuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46421 - RNA, 1410 nt, Artificial Sequence
  neuraminidase__InfluenzaA__ABU92792
augaauccaaaucaaaagauaauaacgauuggcucuguuucucucaccauuuccacaauaugcuucuucaugcaaauugccaucuugauaacuacuguaacauugcauuucaagcaauauguauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 46422 - RNA, 1410 nt, Artificial Sequence; identical to SEQ ID NO: 45888
  neuraminidase__InfluenzaA__ABU92793

SEQ ID NO: 46423 - RNA, 1410 nt, Artificial Sequence; identical to SEQ ID NO: 46418
  neuraminidase__InfluenzaA__ABU92794

SEQ ID NO: 46424 - RNA, 1410 nt, Artificial Sequence; identical to SEQ ID NO: 46409
  neuraminidase__InfluenzaA__ABU92795

SEQ ID NO: 46425 - RNA, 1410 nt, Artificial Sequence
  neuraminidase__InfluenzaA__ABU92796
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagugagaaguugcgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46426 - RNA, 1410 nt, Artificial Sequence
  neuraminidase__InfluenzaA__ABU92797
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaagaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucaacgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46427 - RNA, 1410 nt, Artificial Sequence; identical to SEQ ID NO: 46409
  neuraminidase__InfluenzaA__ABU92798

SEQ ID NO: 46428 - RNA, 1410 nt, Artificial Sequence; identical to SEQ ID NO: 45276
  neuraminidase__InfluenzaA__ABU92799

SEQ ID NO: 46429 - RNA, 1410 nt, Artificial Sequence; identical to SEQ ID NO: 46409
  neuraminidase__InfluenzaA__ABU92800

SEQ ID NO: 46430 - RNA, 1410 nt, Artificial Sequence
  neuraminidase__InfluenzaA__ABU92801
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauagugcaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46431 - RNA, 1410 nt, Artificial Sequence; identical to SEQ ID NO: 45276
  neuraminidase__InfluenzaA__ABU92802

SEQ ID NO: 46432 - RNA, 1410 nt, Artificial Sequence
  neuraminidase__InfluenzaA__ABU92804
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaagguuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46433 - RNA, 1410 nt, Artificial Sequence
  neuraminidase__InfluenzaA__ABU92805
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugucccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 46434 - RNA, 1410 nt, Artificial Sequence
  neuraminidase__InfluenzaA__ABU92806
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 46435 - RNA, 1410 nt, Artificial Sequence
  neuraminidase__InfluenzaA__ABU92808
augaauccaaaucaaaagauaauaacaauuggcucuguuucucucaccauugccacaauaugcuuccuuaugcaaauuaccauccugguaacuacuguaacauugcauuucaagcaguaugaaugcaacucccccccaaacaaccaaguaaugcugugugaaccaacaauaauagaaagaaacauaacagagauaguguaucugaccaauaccacuauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagagccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuaguuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucauucauauuagcacauugucaggaagugcucagcaugucgaggagugcuccuguuauccucgauauccuggcgucagauguguaugccgagacaacuggaaaggcuccaauagacccaucguagauauaaauguaaaggauuauagcauuguuuccaguuaugugugcucaggacuuguuggagacacacccagaaaaaacgacagcuccagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaacaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46436 - RNA, 1410 nt, Artificial Sequence
  neuraminidase__InfluenzaA__ABU92809
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucgugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugacgucuuguggaccucaaacaguauuguuguguuuuguggcaccucagguacauauggaacaggcucauggccugauggggcggauaucaaucucaugccuauauaa

SEQ ID NO: 46437 - RNA, 1410 nt, Artificial Sequence
  neuraminidase__InfluenzaA__ABU92810
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaggagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46438 - RNA, 1410 nt, Artificial Sequence
  neuraminidase__InfluenzaA__ABU92811
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaaugauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcuguuggggacaucugggugacaagagaaccuuaugugucaugcgauccugauaaguguuaucaauuugcccuuggacagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacucaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacucguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggacaucaaacaguauuguuguguuuuguggcaccucagguacauauggaacaggcucauggccugauggggcggauaucaaucucaugccuauauaa

SEQ ID NO: 46439 - RNA, 1410 nt, Artificial Sequence; identical to SEQ ID NO: 46409
  neuraminidase__InfluenzaA__ABU92814

SEQ ID NO: 46440 - RNA, 1410 nt, Artificial Sequence
  neuraminidase__InfluenzaA__ABU92815
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagccgauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46441 - RNA, 1410 nt, Artificial Sequence; identical to SEQ ID NO: 45276
  neuraminidase__InfluenzaA__ABU92816

SEQ ID NO: 46442 - RNA, 1410 nt, Artificial Sequence
  neuraminidase__InfluenzaA__ABU92817
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaagcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46443 - RNA, 1410 nt, Artificial Sequence; identical to SEQ ID NO: 46409
  neuraminidase__InfluenzaA__ABU92818

SEQ ID NO: 46444 - RNA, 1410 nt, Artificial Sequence; identical to SEQ ID NO: 46409
  neuraminidase__InfluenzaA__ABU92819

SEQ ID NO: 46445 - RNA, 1410 nt, Artificial Sequence
  neuraminidase__InfluenzaA__ABU92821
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46446 - RNA, 1410 nt, Artificial Sequence; identical to SEQ ID NO: 46409
  neuraminidase__InfluenzaA__ABU92822

SEQ ID NO: 46447 - RNA, 1410 nt, Artificial Sequence; identical to SEQ ID NO: 44641
  neuraminidase__InfluenzaA__ABU92823

SEQ ID NO: 46448 - RNA, 1410 nt, Artificial Sequence
  neuraminidase__InfluenzaA__ABU92824
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaagaaaugacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46449 - RNA, 1410 nt, Artificial Sequence
  neuraminidase__InfluenzaA__ABU92825
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46450 - RNA, 1410 nt, Artificial Sequence
  neuraminidase__InfluenzaA__ABU92826
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccuaacaaguguuaucaauuugcccuuggacagggaacaacacuaaacaacgugcauucaaaugacacaguacaugauaggaccccuuaucggacccuauugaugaaugaguuaggugucccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46451 - RNA, 1410 nt, Artificial Sequence
  neuraminidase__InfluenzaA__ABU92827
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaauggaaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46452 - RNA, 1410 nt, Artificial Sequence
  neuraminidase__InfluenzaA__ABU92828
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguucaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46453 - RNA, 1410 nt, Artificial Sequence
  neuraminidase__InfluenzaA__ABU92829
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46454 - RNA, 1410 nt, Artificial Sequence
  neuraminidase__InfluenzaA__ABU92830
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccguugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46455 - RNA, 1410 nt, Artificial Sequence; identical to SEQ ID NO: 46409
  neuraminidase__InfluenzaA__ABU92831

SEQ ID NO: 46456 - RNA, 1410 nt, Artificial Sequence; identical to SEQ ID NO: 46409
  neuraminidase__InfluenzaA__ABU92832

SEQ ID NO: 46457 - RNA, 1410 nt, Artificial Sequence
  neuraminidase__InfluenzaA__ABU92833
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauauacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccaaacuccaaauuacagauaaauaggcaaguuauaguugaaagagguaacagguccgguuauucugguauuuucuccguugaaggcaaaaguugcaucaaucggugcuuuuauguggaguugauaaggggaaggaaagaggaaacugaagucugguggaccucaaacaguauuguuguuuuuuguggcaccucagguacauauggaacaggcucauggccugauggggcggauaucaaucucaugccuauauaa

SEQ ID NO: 46458 - RNA, 1410 nt, Artificial Sequence
  neuraminidase__InfluenzaA__ABU92834
augaauccaaaucaaaagauaauaacaauuggcucuguuucucucaccauugccgcaauaugcuuccuuaugcauauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucagucucaugccuauauaa

SEQ ID NO: 46459 - RNA, 1410 nt, Artificial Sequence; identical to SEQ ID NO: 46409
  neuraminidase__InfluenzaA__ABU92835

SEQ ID NO: 46460 - RNA, 1410 nt, Artificial Sequence
  neuraminidase__InfluenzaA__ABU92836
augaauccaaaucaaaagauaauaacaauuggcuccguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccagacaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46461 - RNA, 1410 nt, Artificial Sequence
  neuraminidase__InfluenzaA__ABU92837
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaggcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcgucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46462 - RNA, 1410 nt, Artificial Sequence
  neuraminidase__InfluenzaA__ABU92838
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucucuguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46463 - RNA, 1410 nt, Artificial Sequence; identical to SEQ ID NO: 44673
  neuraminidase__InfluenzaA__ABU92839

SEQ ID NO: 46464 - RNA, 1410 nt, Artificial Sequence
  neuraminidase__InfluenzaA__ABU92840
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauauuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46465 - RNA, 1410 nt, Artificial Sequence
  neuraminidase__InfluenzaA__ABU92841
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagauaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46466 - RNA, 1410 nt, Artificial Sequence
  neuraminidase__InfluenzaA__ABU92842
augaauccaaaucaaaagauaauaacgauuggcucuguuucucucaccauugccacaauaugcuuccuuaugcaaauugccauccugguaacuacuguaacauugcauuucaagcaauaugacugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacggacauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucaggaagugcucagcaugucgaggagugcuccuguuauccucgauacccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46467 - RNA, 1410 nt, Artificial Sequence; identical to SEQ ID NO: 44673
  neuraminidase__InfluenzaA__ABU92843

SEQ ID NO: 46468 - RNA, 1410 nt, Artificial Sequence
  neuraminidase__InfluenzaA__ABU92844
augaauccaaaucaaaagauaauaacgauuggcucuguuucucucaccauugccacaauaugcuuccuuaugcaaauugccauccugguaacuacuguaacauugcauuucaaacaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaauguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauuggcucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauaggucugguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 46469 - RNA, 1410 nt, Artificial Sequence; identical to SEQ ID NO: 44673
  neuraminidase__InfluenzaA__ABU92845

SEQ ID NO: 46470 - RNA, 1410 nt, Artificial Sequence; identical to SEQ ID NO: 44673
  neuraminidase__InfluenzaA__ABU92846

SEQ ID NO: 46471 - RNA, 1410 nt, Artificial Sequence; identical to SEQ ID NO: 44673
  neuraminidase__InfluenzaA__ABU92847

SEQ ID NO: 46472 - RNA, 1410 nt, Artificial Sequence; identical to SEQ ID NO: 44673
  neuraminidase__InfluenzaA__ABU92848

SEQ ID NO: 46473 - RNA, 1410 nt, Artificial Sequence
  neuraminidase__InfluenzaA__ABU92849
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaaaccgcaaugugacauuacaggauuugcaccuuuuucuaaggacaauucgauuaggcuuuccgcugguggggacaucugggugacaagagaaccuuaugugucaugugauccugacaaguguuaucaauuugcccuuggacagggaacaacacuaaacaacgugcauucaaaugacacaguacaugauaggaccccuuaucggacccuauugaugaaugaguuagguguuccauuucaucuagggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46474 - RNA, 1410 nt, Artificial Sequence
  neuraminidase__InfluenzaA__ABU92850
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuaguagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugacugaguuagguguuccauuucaucuggggaccaagcaagugugcauagcaugguccagcucaaguugucacgauggaaaagcauggcugcauguuuguguaacgggggaugauaaaaaugcaacugccagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcuccugcuauccucgauauccuggugucagaugugucugcagagacaacuggaagggcuccaauaggcccaucguagauauaaacauaaaggauuauagcauuguuuccaguuaugugugcucaggacuuguuggagacacaccaagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucucaugccuauauaa

SEQ ID NO: 46475 - RNA, 1410 nt, Artificial Sequence
  neuraminidase__InfluenzaA__ABU92851
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguagcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcauguugaggaaugcuccugcuauccucgauauccuggugucagaugugucugcagagacaacuggaaaggcuccaauaggcccauaguagacauaaacauaaaggauuauagcauuguuuccaguuaugugugcucaggacuuguuggagacacacccagaaaagacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46476 - RNA, 1410 nt, Artificial Sequence; identical to SEQ ID NO: 46409
  neuraminidase__InfluenzaA__ABU92852

SEQ ID NO: 46477 - RNA, 1410 nt, Artificial Sequence
  neuraminidase__InfluenzaA__ABU92853
augaauccaaaucaaaagauaauaacaauuggcucuguuucucucaccauugccgccauaugcuuccuuaugcaaauugccauccugguaacuacuguaacauugcauuucaagcagcaugaaugcaacucccccccaaaaaaccaaguaaugcugugugaaccaacaauaauagaaagaaacauaacagagauaguguauaugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauuguuucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacguucagguuaugaaaccuucaaagucaucgaaggcugguccaaaccaaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46478 - RNA, 1410 nt, Artificial Sequence; identical to SEQ ID NO: 46409
  neuraminidase__InfluenzaA__ABU92854

SEQ ID NO: 46479 - RNA, 1410 nt, Artificial Sequence
  neuraminidase__InfluenzaA__ABU92855
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacacugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaauugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46480 - RNA, 1410 nt, Artificial Sequence
  neuraminidase__InfluenzaA__ABU92856
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgacccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggagaugauaaaaaugcaacugcuagcuucauuuacaaugggaggcuuguagauaguauugguucaugguccaaaaaaauacucagaacccaggagucggaauguguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggaaugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46481 - RNA, 1410 nt, Artificial Sequence; identical to SEQ ID NO: 46409
  neuraminidase__InfluenzaA__ABU92857

SEQ ID NO: 46482 - RNA, 1410 nt, Artificial Sequence
  neuraminidase__InfluenzaA__ABU92858
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauacugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacugaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46483 - RNA, 1410 nt, Artificial Sequence
  neuraminidase__InfluenzaA__ABU92859
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcaggauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46484 - RNA, 1410 nt, Artificial Sequence
  neuraminidase__InfluenzaA__ABU92860
augaauccaaaucaaaagauaauaacaauuggcucuguuucucucaccauugccgcgauaugcuuccuuaugcaaauugccauccugguaacuacuguaacauugcauuucaagcaacaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguacaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuauuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguugcgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46485 - RNA, 1410 nt, Artificial Sequence
  neuraminidase__InfluenzaA__ABU92861
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauggcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucuggcauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46486 - RNA, 1410 nt, Artificial Sequence
  neuraminidase__InfluenzaA__ABU92862
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuagggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46487 - RNA, 1410 nt, Artificial Sequence; identical to SEQ ID NO: 46452
  neuraminidase__InfluenzaA__ABU92863

SEQ ID NO: 46488 - RNA, 1410 nt, Artificial Sequence
  neuraminidase__InfluenzaA__ABU92865
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgaucuugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46489 - RNA, 1410 nt, Artificial Sequence
  neuraminidase__InfluenzaA__ABU92866
augaauccaaaucaaaagauaauaacgauuggcucuguuucucucaccauuuccacaauaugcuucuucaugcaaauugccaucuugauaacuacuguaacauugcauuucaagcaauaugaauucaacuccccuccaaacaaccaagugaugcugugugaaccaacaauaauagaaagaaacauaacagagauaguguaucugaccaacaccaccauagagaaggaaguaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaaggaacaacacuaaacaacgugcauucaaaugacacaguacaugauaggaccccuuaucggacccuauugaugaaugaguuagguguuccauuucaccuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugacgggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaauagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucgaacaguauuguuguguuuuguggcaccucagguacauauggaacaggcucauggccugauggggcggacaucaaucucaugccuauauaa

SEQ ID NO: 46490 - RNA, 1410 nt, Artificial Sequence; identical to SEQ ID NO: 45888
  neuraminidase__InfluenzaA__ABU92867

SEQ ID NO: 46491 - RNA, 1410 nt, Artificial Sequence; identical to SEQ ID NO: 46418
  neuraminidase__InfluenzaA__ABU92868

SEQ ID NO: 46492 - RNA, 1410 nt, Artificial Sequence
  neuraminidase__InfluenzaA__ABU92869
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46493 - RNA, 1410 nt, Artificial Sequence
  neuraminidase__InfluenzaA__ABU92870
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggagacuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46494 - RNA, 1410 nt, Artificial Sequence
  neuraminidase__InfluenzaA__ABU92872
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauaacauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucaggcacauauggaacaggcucauggccugauggggcggauaucaaucucaugccuauauaa

SEQ ID NO: 46495 - RNA, 1410 nt, Artificial Sequence
  neuraminidase__InfluenzaA__ABU92873
augaauccaaaucaaaagauaauaacaauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaauuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaagaggaagaaaacaggaaacugaagucuuguggaccucaaacaguauuguuguguuuuguggcaccucagguacauauggaacaggcucauggccugauggggcggacaucaauaucaugccuauauaa

SEQ ID NO: 46496 - RNA, 1410 nt, Artificial Sequence
  neuraminidase__InfluenzaA__ABU92874
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacucaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcucaaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 46497 - RNA, 1410 nt, Artificial Sequence
  neuraminidase__InfluenzaA__ABU92875
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggacuccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46498 - RNA, 1410 nt, Artificial Sequence
  neuraminidase__InfluenzaA__ABU92876
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuuuauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46499 - RNA, 1410 nt, Artificial Sequence
  neuraminidase__InfluenzaA__ABU92877
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46500 - RNA, 1410 nt, Artificial Sequence; identical to SEQ ID NO: 46409
  neuraminidase__InfluenzaA__ABU92878

SEQ ID NO: 46501 - RNA, 1410 nt, Artificial Sequence
  neuraminidase__InfluenzaA__ABU92879
augaauccaaaucaaaagauaauaacaauuggcucuguuucccucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaaggggaaacugaagucugguggaccucaaacaguauuguuguguuuuguggcaccucagguacauauggaacaggcucauggccugauggggcggauaucaaucucaugccuauauaa

SEQ ID NO: 46502 - RNA, 1410 nt, Artificial Sequence
  neuraminidase__InfluenzaA__ABU92880
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauaacauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46503 - RNA, 1410 nt, Artificial Sequence; identical to SEQ ID NO: 46409
  neuraminidase__InfluenzaA__ABU92881

SEQ ID NO: 46504 - RNA, 1410 nt, Artificial Sequence; identical to SEQ ID NO: 45276
  neuraminidase__InfluenzaA__ABU92882

SEQ ID NO: 46505 - RNA, 1410 nt, Artificial Sequence
  neuraminidase__InfluenzaA__ABU92883
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaaaaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauuguuucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacguucagguuaugaaaccuucaaagucaucgaaggcugguccaaaccaaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46506 - RNA, 1410 nt, Artificial Sequence
  neuraminidase__InfluenzaA__ABU92884
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucagggcuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46507 - RNA, 1410 nt, Artificial Sequence
  neuraminidase__InfluenzaA__ABU92885
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucaggugugucuguagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46508 - RNA, 1410 nt, Artificial Sequence
  neuraminidase__InfluenzaA__ABU92886
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuagggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46509 - RNA, 1410 nt, Artificial Sequence
  neuraminidase__InfluenzaA__ABU92887
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuucagcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagccugguccagcucaaguugucacgauggaaaagcguggcuacauguuuguguaacuggggaugauaaaaaugcaacugcuagcuucauauacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccaaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguuuuuuguggcaccucagguacauauggaacaggcucauggccugauggggcggauaucaaucucaugccuauauaa

SEQ ID NO: 46510 - RNA, 1410 nt, Artificial Sequence
  neuraminidase__InfluenzaA__ABU92888
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccuguuauccucgauauccuggugucagaugugucugcagagacaacuggaaaggcuccaauaggcccaucguagauauaaacauaaaggauuauagcauuauuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucguugaaggcugguccaacccuaacuccaaauugcagauaaauaggcaagucauaguugacagagauaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 46511 - RNA, 1410 nt, Artificial Sequence; identical to SEQ ID NO: 46434
  neuraminidase__InfluenzaA__ABU92889

SEQ ID NO: 46512 - RNA, 1410 nt, Artificial Sequence
  neuraminidase__InfluenzaA__ABU92890
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccagacaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugguaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46513 - RNA, 1410 nt, Artificial Sequence; identical to SEQ ID NO: 46449
  neuraminidase__InfluenzaA__ABU92891

SEQ ID NO: 46514 - RNA, 1410 nt, Artificial Sequence
  neuraminidase__InfluenzaA__ABU92892
augaauccaaaucaaaagauaauaacgauuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcuggugggaacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46515 - RNA, 1410 nt, Artificial Sequence
  neuraminidase__InfluenzaA__ABU92893
augaauccaaaucaaaagauaauaacaauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagggguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 46516 - RNA, 1410 nt, Artificial Sequence
  neuraminidase__InfluenzaA__ABU92895
augaauccaaaucaaaagauaauaacgguuggcucuguuucucucaccauuuccacaauaugcuucuucaugcaaauugccaucuugauaacuacuguaacauugcauuuuaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggacgauaaaaaugcaacugcuagcuucauuuacaaugggaggcuuguagauaguauuguuucaugguccaaagaaauccucaggacccaggagucagaaugcguuuguaucaauggaacuuguacaguaguaaugaccgaugggagugcuucaggaaaagcugauacuaaaauacuguucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauugcuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46517 - RNA, 1410 nt, Artificial Sequence
  neuraminidase__InfluenzaA__ABU92896
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacggggaaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauagaaaugacguguggaugggaagaacgaucagcgagaagucacgcuuaggauaugagaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggcaccucagguacauauggaacaggcucauggccugauggggcggacaucaaucucaugccuauauaa

SEQ ID NO: 46518 - RNA, 1410 nt, Artificial Sequence
  neuraminidase__InfluenzaA__ABU92897
augaauccaaaucaaaagauaauaacgauuggcucuguuucucucaccauuuccacaauaugcuucuucaugcaaauugccaucuugauaacuacuguaacauugcauuucaagcaauaugaacucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaacucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaacaggcccauaguagacauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucugguacauauggaacaggcucauggccugauggggcggacaucaaucucaugccuauauaa

SEQ ID NO: 46519 - RNA, 1410 nt, Artificial Sequence
  neuraminidase__InfluenzaA__ABU92898
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagaaccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 46520 - RNA, 1410 nt, Artificial Sequence
  neuraminidase__InfluenzaA__ABU92899
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccaaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46521 - RNA, 1410 nt, Artificial Sequence
  neuraminidase__InfluenzaA__ABU92900
augaauccaaaucaaaagauaauaacaauuggcucuguuucucucaccauugccgcaauaugcuuccuuaugcaaauugccauccugguaacuacuguaacauugcauuucaagcagcaugaaugcaacccccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccaaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46522 - RNA, 1410 nt, Artificial Sequence
  neuraminidase__InfluenzaA__ABU92901
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauuaguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46523 - RNA, 1410 nt, Artificial Sequence; identical to SEQ ID NO: 46409
  neuraminidase__InfluenzaA__ABU92902

SEQ ID NO: 46524 - RNA, 1410 nt, Artificial Sequence; identical to SEQ ID NO: 46460
  neuraminidase__InfluenzaA__ABU92903

SEQ ID NO: 46525 - RNA, 1410 nt, Artificial Sequence
  neuraminidase__InfluenzaA__ABU92904
augaauccaaaucaaaagauaauaacgauuggcucuguuucucucacuauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46526 - RNA, 1410 nt, Artificial Sequence; identical to SEQ ID NO: 46411
  neuraminidase__InfluenzaA__ABU92905

SEQ ID NO: 46527 - RNA, 1410 nt, Artificial Sequence
  neuraminidase__InfluenzaA__ABU92906
augaauccaaaucaaaagauaauaacaauuggcucuguuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaacucaugccuauauaa

SEQ ID NO: 46528 - RNA, 1410 nt, Artificial Sequence
  neuraminidase__InfluenzaA__ABU92907
augaauccaaaucaaaagauaauaacaauuggcucuauuucucucaccauugccgcgauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucagggaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46529 - RNA, 1410 nt, Artificial Sequence; identical to SEQ ID NO: 46409
  neuraminidase__InfluenzaA__ABU92908

SEQ ID NO: 46530 - RNA, 1410 nt, Artificial Sequence
  neuraminidase__InfluenzaA__ABU92909
augaauccaaaucaaaagauaauaacaauuggcucuguuucucucaccauugccgcaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacagugguaaugacugauggaagcgcuucaggaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccaaacuccaaauuacagauaaauaggcaaguuauaguugaaagagguaacagguccgguuauucugguauuuucuccguugaaggcaaaagcugcaucaaucggugcuucuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 46531 - RNA, 1410 nt, Artificial Sequence
  neuraminidase__InfluenzaA__ABU92910
augaauccaaaucaaaaaauaauaacgauuggcucuguuucucucaccauugccacaauaugcuuccuuacgcaaauugcuauccugauaacuacuguaacauugcauuucaagcaauaugaaugcaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaaugggacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaagggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacaaagguaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcacuucagguacauauggaacaggcucauggccugauggggcggacaucaaucucaugccuauauaa

SEQ ID NO: 46532 - RNA, 1410 nt, Artificial Sequence
  neuraminidase__InfluenzaA__ABU92911
augaauccaaaucaaaagauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugacaaacaccaccauagagaaggaaauaugccccaaacaagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguuaauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 46533 - RNA, 1410 nt, Artificial Sequence
  neuraminidase__InfluenzaA__ABU92913
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauuaaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguuaauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 46534 - RNA, 1413 nt, Artificial Sequence
  neuraminidase__InfluenzaA__ABV29560
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaauuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46535 - RNA, 1413 nt, Artificial Sequence
  neuraminidase__InfluenzaA__ABV29571
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46536 - RNA, 1413 nt, Artificial Sequence; identical to SEQ ID NO: 46535
  neuraminidase__InfluenzaA__ABV29582

SEQ ID NO: 46537 - RNA, 1413 nt, Artificial Sequence
  neuraminidase__InfluenzaA__ABV29615
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46538 - RNA, 1413 nt, Artificial Sequence
  neuraminidase__InfluenzaA__ABV29637
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaaugggaccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaucugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46539 - RNA, 1413 nt, Artificial Sequence
  neuraminidase__InfluenzaA__ABV29648
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuauuaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugaguuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46540 - RNA, 1413 nt, Artificial Sequence
  neuraminidase__InfluenzaA__ABV29659
augaauccaaaucaaaaaauaauaaccauuggaucaaucaguauagcaauagggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46541 - RNA, 1413 nt, Artificial Sequence
  neuraminidase__InfluenzaA__ABV29670
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46542 - RNA, 1413 nt, Artificial Sequence
  neuraminidase__InfluenzaA__ABV29681
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcauugauagugauacugcaaacuggucuuggccagacggugcugaguugccguucaccauugacaaguag

SEQ ID NO: 46543 - RNA, 1413 nt, Artificial Sequence
  neuraminidase__InfluenzaA__ABV29692
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagagaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaaaggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46544 - RNA, 1413 nt, Artificial Sequence
  neuraminidase__InfluenzaA__ABV29703
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46545 - RNA, 1410 nt, Artificial Sequence
  neuraminidase__InfluenzaA__ABV29714
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46546 - RNA, 1410 nt, Artificial Sequence
  neuraminidase__InfluenzaA__ABV29725
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagggaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuuuccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46547 - RNA, 1413 nt, Artificial Sequence
  neuraminidase__InfluenzaA__ABV29736
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguuacuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucacuauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacaaacuuagaaaaggguuugagaugauuugggauccuaauggauggacagauaccgacaaugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46548 - RNA, 1413 nt, Artificial Sequence
  neuraminidase__InfluenzaA__ABV29747
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaguguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugagacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46549 - RNA, 1413 nt, Artificial Sequence
  neuraminidase__InfluenzaA__ABV29769
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggcccuaaugagcuguccucuaggugaagcuccgucuccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46550 - RNA, 1413 nt, Artificial Sequence
  neuraminidase__InfluenzaA__ABV29780
augaauccaaaucaaaaaauaauaaccauuggaucaaucaguauagcaaucggaauaauuaguuuaauguugcaaauaggaaauauuauuucaauaugggcuagucacucaauccaaacuggaagucaaaaccacacuggaauaugcaaccaaagaaucaucacauaugaaaacagcaccugggugaaccacacauauguuaauauuaacaacacuaauguuguuacuggaaaggacaaaacuucagugacauuggccggcaauucaucccuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacggaucauguuucacuauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguagcaaacuuagaaaaggguuugagaugauuugggauccuaauggauggacagauaccgacaaugauuucucagugaaacaggauguuguggcaauaacugauuggucaggguacaguggaaguuucguucaacauccugaguuaacaggauuggacuguauaaggccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46551 - RNA, 1413 nt, Artificial Sequence
  neuraminidase__InfluenzaA__ABV29791
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuauuaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46552 - RNA, 1413 nt, Artificial Sequence
  neuraminidase__InfluenzaA__ABV29802
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46553 - RNA, 1410 nt, Artificial Sequence
  neuraminidase__InfluenzaA__ABV29824
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46554 - RNA, 1413 nt, Artificial Sequence
  neuraminidase__InfluenzaA__ABV29835
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaaucggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaaugggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46555 - RNA, 1413 nt, Artificial Sequence
  neuraminidase__InfluenzaA__ABV29846
augaauccaaaucaaaaaauaauaaccauuggaucaaucaguauagcaauuggaauaauuagucuaauguugcaaauaggaaauauuauuucaauaugggcuagucacucaauccaaauuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuuggguaucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugacacugcaaacuggucuuggccagacggugcugaguugccguucaccauugacaaauag

SEQ ID NO: 46556 - RNA, 1413 nt, Artificial Sequence
  neuraminidase__InfluenzaA__ABV29879
augaauccaaaucaaaaaauaauaaccauuggaucaaucaguauagcaaucgggauaauuagucuaauguuacaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuuaucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46557 - RNA, 1413 nt, Artificial Sequence
  neuraminidase__InfluenzaA__ABV29890
augaauccaaaucaaaaaauaauaaccauuggaucaaucaguauagcaauagggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaacccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46558 - RNA, 1410 nt, Artificial Sequence
  neuraminidase__InfluenzaA__ABV29901
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcuguaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46559 - RNA, 1410 nt, Artificial Sequence
  neuraminidase__InfluenzaA__ABV29912
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugauaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucaugauggaaaagcauggcugcauguuuguguaacuggggaugauaaaaaugcaacugcuagcuucauuuauaaugggaggcuuguggauaguauuguuucaugguccaaagauauccucaggacccaggagucagaaugcauuuguaucaauggaacuuguacaguaguaaugacugaugggagugcuucaggaaaagcugauacuaagauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccaguuauguaugcucaggacuuguuggagacacacccagaaaaaaugacaguuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaacuccaaauugcagauaaauaggcaagucauaguugacaaagguaauagguccggcuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 46560 - RNA, 1413 nt, Artificial Sequence
  neuraminidase__InfluenzaA__ABV29923
augaauccaaaucaaaaaauaauaaccauuggaucgaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaauuggucuuggccagacggugcugaguugccguucaccauugacaaauag

SEQ ID NO: 46561 - RNA, 1410 nt, Artificial Sequence
  neuraminidase__InfluenzaA__ABV29934
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaggaccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46562 - RNA, 1413 nt, Artificial Sequence; identical to SEQ ID NO: 46547
  neuraminidase__InfluenzaA__ABV29945

SEQ ID NO: 46563 - RNA, 1413 nt, Artificial Sequence
  neuraminidase__InfluenzaA__ABV29956
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaaaggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46564 - RNA, 1413 nt, Artificial Sequence
  neuraminidase__InfluenzaA__ABV29989
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucaugagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46565 - RNA, 1413 nt, Artificial Sequence
  neuraminidase__InfluenzaA__ABV30000
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagggaaaauacaacaaucuggacuagugggagcagcauuucuuuuuguggcguugauagugauacugcaaacuggucuuggccagacggugcugaguugccguucaccauugacaaguag

SEQ ID NO: 46566 - RNA, 1413 nt, Artificial Sequence
  neuraminidase__InfluenzaA__ABV30011
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuauuaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccauccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46567 - RNA, 1413 nt, Artificial Sequence; identical to SEQ ID NO: 46535
  neuraminidase__InfluenzaA__ABV30022

SEQ ID NO: 46568 - RNA, 1413 nt, Artificial Sequence
  neuraminidase__InfluenzaA__ABV30044
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagggacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaagcuucguucaacauccugaguuaacaggauuggacuguauaagaccuugcuucuggguugaguuagucagaggacugccuagagaaaauacaacaaucuggacuagugggagcagcauuuccuuuuguggcguugauagugauacugcaaacuggucuuggccagacggugcugaguugccguucaccauugacaaauag

SEQ ID NO: 46569 - RNA, 1413 nt, Artificial Sequence
  neuraminidase__InfluenzaA__ABV30055
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguuugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46570 - RNA, 1410 nt, Artificial Sequence
  neuraminidase__InfluenzaA__ABV30077
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauagacaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46571 - RNA, 1413 nt, Artificial Sequence; identical to SEQ ID NO: 46552
  neuraminidase__InfluenzaA__ABV30088

SEQ ID NO: 46572 - RNA, 1413 nt, Artificial Sequence; identical to SEQ ID NO: 46565
  neuraminidase__InfluenzaA__ABV30099

SEQ ID NO: 46573 - RNA, 1413 nt, Artificial Sequence
  neuraminidase__InfluenzaA__ABV30110
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46574 - RNA, 1413 nt, Artificial Sequence; identical to SEQ ID NO: 46540
  neuraminidase__InfluenzaA__ABV30132

SEQ ID NO: 46575 - RNA, 1413 nt, Artificial Sequence
  neuraminidase__InfluenzaA__ABV30143
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuuuauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46576 - RNA, 1413 nt, Artificial Sequence
  neuraminidase__InfluenzaA__ABV30154
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugaaaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaguag

SEQ ID NO: 46577 - RNA, 1413 nt, Artificial Sequence
  neuraminidase__InfluenzaA__ABV30165
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauuuaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgcaucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46578 - RNA, 1413 nt, Artificial Sequence; identical to SEQ ID NO: 46552
  neuraminidase__InfluenzaA__ABV30187

SEQ ID NO: 46579 - RNA, 1413 nt, Artificial Sequence
  neuraminidase__InfluenzaA__ABV30198
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaauuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46580 - RNA, 1410 nt, Artificial Sequence
  neuraminidase__InfluenzaA__ABV30209
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccacaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46581 - RNA, 1410 nt, Artificial Sequence
  neuraminidase__InfluenzaA__ABV30220
augaauccaaaucaaaagauaauaacgauuggcucuguuucucucaccauuuccacaauauguuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46582 - RNA, 1410 nt, Artificial Sequence
  neuraminidase__InfluenzaA__ABV30231
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46583 - RNA, 1410 nt, Artificial Sequence
  neuraminidase__InfluenzaA__ABV30264
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaggugaugcugugugaaccaacaauaauagaaagaaacauaacagagguaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaacaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 46584 - RNA, 1410 nt, Artificial Sequence
  neuraminidase__InfluenzaA__ABV30275
augaauccaaaucaaaagauaauaacgauuggcucuguuucucucaccauuuccacaauaugcuucuucaugcaaacugccaucuugauaacuacuguaacauugcauuucaagcaauaugaauucaacuccaccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46585 - RNA, 1413 nt, Artificial Sequence
  neuraminidase__InfluenzaA__ABV30297
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46586 - RNA, 1413 nt, Artificial Sequence
  neuraminidase__InfluenzaA__ABV30308
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucuguuugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46587 - RNA, 1413 nt, Artificial Sequence
  neuraminidase__InfluenzaA__ABV30319
augaauccaaaucaaaaaauaauaaccauuggaucaaucaguauagcaaucgggauaauuagucuaauguugcaaauaggaaauauuguuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaggacaacagcauaagaauuggcuccaaaggagauguuuuugucauaagagaaccuuucauaucauguucucauuuggaaugcaggaccuuuuuucugacccaaggugcuuuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46588 - RNA, 1413 nt, Artificial Sequence; identical to SEQ ID NO: 46585
  neuraminidase__InfluenzaA__ABV30330

SEQ ID NO: 46589 - RNA, 1413 nt, Artificial Sequence; identical to SEQ ID NO: 46537
  neuraminidase__InfluenzaA__ABV30341

SEQ ID NO: 46590 - RNA, 1413 nt, Artificial Sequence; identical to SEQ ID NO: 46557
  neuraminidase__InfluenzaA__ABV30363

SEQ ID NO: 46591 - RNA, 1413 nt, Artificial Sequence
  neuraminidase__InfluenzaA__ABV30374
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugucaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46592 - RNA, 1410 nt, Artificial Sequence
  neuraminidase__InfluenzaA__ABV30385
augaauccaaaucaaaagauaauaacgauuggcucuguuucucucaccauuuccacaauaugcuucuucaugcaaauugccaucuugauaacuacuguaacauugcauuucaagcaauaugaauucagcccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggagacuuguagauaguauuguuucaugguccaaagaaauccucaggacccaggagucagaaugcguuuguaucaauggaacuuguacaguaguaaugacugaugggagugcuucaggaaaagcugauacuaaaauacuguucauugaggaggggaaaaucguucauacuagcacauugucaggaagugcucaacaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 46593 - RNA, 1410 nt, Artificial Sequence
  neuraminidase__InfluenzaA__ABV30396
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaaggaacauaacagagauaguguaucugaccaacaccaccauagagaaggaaauaugccccaaacuaucagaauacagaaauuggucaaagccgcaauguaacauuacaggauuugcaccuuuuucuaaggacaauucgauuaggcuuuccgcugguggggacaucuggguaacaagagaaccuuaugugucaugcgauccugacaaguguuaucaauucgcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaggaaauccucaggacccaggagucagaaugcguuuguaucaauggaacuuguacaguaguaaugacugaugggagugcuucaggaaaagcugauacuaaaauacuauucauugaagaggggaaaaucguucauacuagcacauugucaggaagugcucagcaugucgaggagugcuccugcuauccucgauauccuggugucagaugugucugcagagacaacuggaaaggcuccaauaggcccauaguagauauuaacauaaaggauuauagcauuguuuccaguuaugugugcucaggacuuguuggagacacacccagaaaaaacgacagcuccagcaguagccauugcuuggacccuaacaaugaagaagguggucauggagugaaaggcugggcauuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggcaccucagguacauauggaacaggcucauggccugauggggcggacaucaaucuuaugccuauauaa

SEQ ID NO: 46594 - RNA, 1410 nt, Artificial Sequence
  neuraminidase__InfluenzaA__ABV30407
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguauguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46595 - RNA, 1410 nt, Artificial Sequence
  neuraminidase__InfluenzaA__ABV30418
augaauccaaaucaaaagauaauaacgauuggcucuguuucucucaccauuuccacaauaugcuucuucaugcaaauugccaucuugauaacuacuguaacauugcauuucaagcaauaugaauucagcucccucccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucgguguuuuuauguggaguugauaaggggaagaagagaggagacugaaguuuuguggaccucaaacaguauuguuguguuuuguggcaccucggguacauauggaacaggcucauggccugauggggcggacaucaaucucaugccuauauaa

SEQ ID NO: 46596 - RNA, 1410 nt, Artificial Sequence; identical to SEQ ID NO: 46561
  neuraminidase__InfluenzaA__ABV30429

SEQ ID NO: 46597 - RNA, 1410 nt, Artificial Sequence; identical to SEQ ID NO: 46561
  neuraminidase__InfluenzaA__ABV30440

SEQ ID NO: 46598 - RNA, 1410 nt, Artificial Sequence; identical to SEQ ID NO: 46561
  neuraminidase__InfluenzaA__ABV30451

SEQ ID NO: 46599 - RNA, 1413 nt, Artificial Sequence; identical to SEQ ID NO: 46537
  neuraminidase__InfluenzaA__ABV30462

SEQ ID NO: 46600 - RNA, 1410 nt, Artificial Sequence; identical to SEQ ID NO: 46561
  neuraminidase__InfluenzaA__ABV30473

SEQ ID NO: 46601 - RNA, 1410 nt, Artificial Sequence
  neuraminidase__InfluenzaA__ABV30484
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaauagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaacaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 46602 - RNA, 1413 nt, Artificial Sequence; identical to SEQ ID NO: 46573
  neuraminidase__InfluenzaA__ABV30495

SEQ ID NO: 46603 - RNA, 1413 nt, Artificial Sequence; identical to SEQ ID NO: 46579
  neuraminidase__InfluenzaA__ABV30506

SEQ ID NO: 46604 - RNA, 1410 nt, Artificial Sequence; identical to SEQ ID NO: 46582
  neuraminidase__InfluenzaA__ABV30517

SEQ ID NO: 46605 - RNA, 1413 nt, Artificial Sequence
  neuraminidase__InfluenzaA__ABV30528
augaauucaaaucaaaaaauaauaaccauuggaucaaucaguauagcaauuggaauaauuagucuaauguugcaaauaggaaauauuauuucaaugugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugaaaugauuugggauccuaauggauggacagauaccgacagugauuucucagugaaacaggauguuguggcaauaaccgauuggucaggguacaguggcaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46606 - RNA, 1413 nt, Artificial Sequence
  neuraminidase__InfluenzaA__ABV30539
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugagcuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46607 - RNA, 1413 nt, Artificial Sequence
  neuraminidase__InfluenzaA__ABV30561
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucucuuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46608 - RNA, 1413 nt, Artificial Sequence
  neuraminidase__InfluenzaA__ABV30572
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggagccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46609 - RNA, 1413 nt, Artificial Sequence; identical to SEQ ID NO: 46606
  neuraminidase__InfluenzaA__ABV30583

SEQ ID NO: 46610 - RNA, 1413 nt, Artificial Sequence
  neuraminidase__InfluenzaA__ABV30594
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaagauguuguggcaauaacugauuggucaggguacaguggaaguuucguccaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46611 - RNA, 1413 nt, Artificial Sequence
  neuraminidase__InfluenzaA__ABV30605
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguuguuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46612 - RNA, 1413 nt, Artificial Sequence; identical to SEQ ID NO: 46537
  neuraminidase__InfluenzaA__ABV30616

SEQ ID NO: 46613 - RNA, 1413 nt, Artificial Sequence; identical to SEQ ID NO: 46537
  neuraminidase__InfluenzaA__ABV30627

SEQ ID NO: 46614 - RNA, 1410 nt, Artificial Sequence
  neuraminidase__InfluenzaA__ABV30649
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaugcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccacuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46615 - RNA, 1410 nt, Artificial Sequence; identical to SEQ ID NO: 46553
  neuraminidase__InfluenzaA__ABV30660

SEQ ID NO: 46616 - RNA, 1413 nt, Artificial Sequence
  neuraminidase__InfluenzaA__ABV45852
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguuccaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaauaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46617 - RNA, 1410 nt, Artificial Sequence; identical to SEQ ID NO: 46553
  neuraminidase__InfluenzaA__ABV45863

SEQ ID NO: 46618 - RNA, 1413 nt, Artificial Sequence
  neuraminidase__InfluenzaA__ABV45874
augaauccaaaucaaaaaauaauaaccauuggaucaaucaguauagcaauagggauaauuagucuaauguugcaaauaggaaauauuauuucaauaugggcuaguuacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaacccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcaguauuucuuuuuguggcguugauagugauacugcaaacuggucuuggccagacggugcugaguugccguucaccauugacaaguag

SEQ ID NO: 46619 - RNA, 1413 nt, Artificial Sequence
  neuraminidase__InfluenzaA__ABV45885
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguuuacuauugacaaguag

SEQ ID NO: 46620 - RNA, 1413 nt, Artificial Sequence
  neuraminidase__InfluenzaA__ABV45896
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguuacuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucacuauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacaaacuuagaaagggguuugagaugauuugggauccuaauggauggacagauaccgacaaugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46621 - RNA, 1413 nt, Artificial Sequence; identical to SEQ ID NO: 46537
  neuraminidase__InfluenzaA__ABV45918

SEQ ID NO: 46622 - RNA, 1413 nt, Artificial Sequence
  neuraminidase__InfluenzaA__ABV45929
augaauccaaaucaaaaaauaauaaccauuggaucaaucaguauagcaaucggaauaauuagucuaauguugcaaauaggaaauauuauuucaaugugggcuagucacucaauccaaacuggaagucaaaaccacacuggaauaugcaaccaaagaaucaucacauaugaaaacagcaccugggugaaucacacauauguuaauauuaacaacacuaauguuguuacuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucacuauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacaaacuuagaaagggguuugagaugauuugggauccuaauggauggacagauaccgacaaugauuucucagugaaacaggauguuguggcaauaacugauuggucaggauacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46623 - RNA, 1413 nt, Artificial Sequence
  neuraminidase__InfluenzaA__ABV45940
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucagauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcaaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaagcuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccaaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46624 - RNA, 1413 nt, Artificial Sequence
  neuraminidase__InfluenzaA__ABV45951
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugaaaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46625 - RNA, 1410 nt, Artificial Sequence
  neuraminidase__InfluenzaA__ABV45973
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaguuucauuuacaaugggaggcuuguagauaguauuguuucaugguccaaagaaauccucaggacccaggagucagaaugcguuuguaucaauggaacuuguacaguaguaaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacaguuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugacgucuuguggaccucaaacaguauuguuguguuuuguggcaccucagguacauauggaacaggcucauggccugauggggcggacaucaaucucaugccuauauaa

SEQ ID NO: 46626 - RNA, 1410 nt, Artificial Sequence
  neuraminidase__InfluenzaA__ABV45984
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46627 - RNA, 1410 nt, Artificial Sequence; identical to SEQ ID NO: 46553
  neuraminidase__InfluenzaA__ABV45995

SEQ ID NO: 46628 - RNA, 1413 nt, Artificial Sequence; identical to SEQ ID NO: 46620
  neuraminidase__InfluenzaA__ABV82554

SEQ ID NO: 46629 - RNA, 1410 nt, Artificial Sequence
  neuraminidase__InfluenzaA__ABV82565
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacacaaccauagagaaggaaauaugcccuaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuugucggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguuuuuuguggcaccucagguacauauggaacaggcucauggccugauggggcggacaucaaucucaugccuauauaa

SEQ ID NO: 46630 - RNA, 1410 nt, Artificial Sequence; identical to SEQ ID NO: 46582
  neuraminidase__InfluenzaA__ABW36171

SEQ ID NO: 46631 - RNA, 1413 nt, Artificial Sequence; identical to SEQ ID NO: 46586
  neuraminidase__InfluenzaA__ABW36193

SEQ ID NO: 46632 - RNA, 1413 nt, Artificial Sequence; identical to SEQ ID NO: 46552
  neuraminidase__InfluenzaA__ABW36204

SEQ ID NO: 46633 - RNA, 1413 nt, Artificial Sequence
  neuraminidase__InfluenzaA__ABW36215
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaaggaucaucacauaugaaaacagcaccugggugaaucacacauauguuaauauuaacaacacuaauguuguugcuggaaaggacaaaacuucagugacacuggccggcaauucaucucuuuguucuauuaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagccccguccccauacaauucaaaguuugaaucaguugcauggucagcaagcgcaugccaugauggcaagggcugguuaacaaucggaauuucugguccagacaauggagcuguggcuguacuaaaauacaacggaauaauaacugaaaccauaaaaaguuggaacaagcaaauauugagaacacaagagucugaauguguuugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauuggauacaucugcaguggaguuuucggugacaauccgcgucccaaagauggaaggggcagcuguaauccagugacuguugauggagcagacggaguuaagggguuuucauacaaauaugguaaugguguuuggauaggaaggacuaaaaguaacagacuaagaaagggguuugagaugauuugggauccuaauggauggacagauaccgacagucauuucucagugaaacaggauguuguggcaauaacugauuggucaggguacagcggaaguuucguccaacauccugaguuaacaggguuggacuguauaaaaccuugcuucuggguugaguuagucagaggacugccuagagaaaauacaacaaucuggacuagcgggagcagcauuucuuuuuguggcguugauagugauacugcaaacuggucuuggccagacggugcugaguugccguucaucauugacaaguag

SEQ ID NO: 46634 - RNA, 1413 nt, Artificial Sequence; identical to SEQ ID NO: 46551
  neuraminidase__InfluenzaA__ABW36226

SEQ ID NO: 46635 - RNA, 1413 nt, Artificial Sequence
  neuraminidase__InfluenzaA__ABW36237
augaauccaaaucaaaaaauaauaaccauuggaucaaucaguauaacaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46636 - RNA, 1413 nt, Artificial Sequence; identical to SEQ ID NO: 46551
  neuraminidase__InfluenzaA__ABW36248

SEQ ID NO: 46637 - RNA, 1413 nt, Artificial Sequence
  neuraminidase__InfluenzaA__ABW36259
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauagggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcacgguucaaaucgaccuugggugucuuuuaaucaaaacuuggauuaucaaauaggauacaucugcaguggagugcucggugacaauccgcgucccgaagauggagagggcagcugcaauccagugacuguugauggagcagacggagugaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugagcuaacaggauuggacuguauaagaccuugcuucuggguugaguuagucagagggcugccuagagaaaauacaacaaucuggacuagugggagcagcauuucuuuuuguggcguuaguagugauacugcaaacuggucuuggccagacggugcugaguugccguucaccauugacaaguag

SEQ ID NO: 46638 - RNA, 1413 nt, Artificial Sequence
  neuraminidase__InfluenzaA__ABW36281
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggcgcugaguugccguucacuauugacaaguag

SEQ ID NO: 46639 - RNA, 1413 nt, Artificial Sequence
  neuraminidase__InfluenzaA__ABW36292
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuacgaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46640 - RNA, 1413 nt, Artificial Sequence
  neuraminidase__InfluenzaA__ABW36303
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguuacuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucacuauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaagaguaacaaacuuagaaaaggguuugagaugauuugggauccuaauggauggacagauaccgacaaugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46641 - RNA, 1413 nt, Artificial Sequence
  neuraminidase__InfluenzaA__ABW36314
augaauccaaaucagaaaauaauaaccauuggaucaaucuguauggcaaucggaauaauuagucuaauauugcaaauagggaauauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagcuggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucaugauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggcaggccucguacagaaucuucaaaaucgagaaggggaagauuacuaaaucaauagaguuggaugcacccaauuuucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugaguuaacaggauuggacuguaugaggccuugcuucuggguugaauuaaucagaggacgacccagagaaaaaacaacgaucuggacuagugggagcagcauuucuuuuuguggcgugaauagugauacuguaaauuggucuuggccagacggugcugaguugccauucaccauugacaaguag

SEQ ID NO: 46642 - RNA, 1410 nt, Artificial Sequence
  neuraminidase__InfluenzaA__ABW38366
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguauugcuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 46643 - RNA, 1413 nt, Artificial Sequence; identical to SEQ ID NO: 46633
  neuraminidase__InfluenzaA__ABW39780

SEQ ID NO: 46644 - RNA, 1413 nt, Artificial Sequence
  neuraminidase__InfluenzaA__ABW39809
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuuuagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagacccugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46645 - RNA, 1413 nt, Artificial Sequence; identical to SEQ ID NO: 46547
  neuraminidase__InfluenzaA__ABW39820

SEQ ID NO: 46646 - RNA, 1413 nt, Artificial Sequence
  neuraminidase__InfluenzaA__ABW39831
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaauaggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 46647 - RNA, 1413 nt, Artificial Sequence
  neuraminidase__InfluenzaA__ABW39842
augaauccaaaucaaaaaauaauaaccauuggaucaaucaguauagcaauuggaauaauuagucuaauguuacaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaaaggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaauuggucuuggccagacggugcugaguugccguucaccauugacaaauag

SEQ ID NO: 46648 - RNA, 1413 nt, Artificial Sequence
  neuraminidase__InfluenzaA__ABW39864
augaauccaaaucaaaaaauaauaaccauuggaucaaucaguauagcaauagggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcugggaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46649 - RNA, 1410 nt, Artificial Sequence; identical to SEQ ID NO: 46582
  neuraminidase__InfluenzaA__ABW39875

SEQ ID NO: 46650 - RNA, 1413 nt, Artificial Sequence
  neuraminidase__InfluenzaA__ABW39886
augaauccaaaucaaaaaauaauaaccauuggaucaaucaguauagcaaucgggauaauuagucuaauauugcaaauaggaaauauuauuucaauaugggcuagucacucaauccaaacuagaaaucaaaaccacacuggaauaugcaaccaaagaaucaucacauaugaaaacagcaccugggugaaucacacauauguuaguaucaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcguccuaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46651 - RNA, 1413 nt, Artificial Sequence; identical to SEQ ID NO: 46557
  neuraminidase__InfluenzaA__ABW39897

SEQ ID NO: 46652 - RNA, 1413 nt, Artificial Sequence
  neuraminidase__InfluenzaA__ABW39908
augaauccaaaucaaaaaauaauaaccauuggaucaaucaguauagcaaucggaauaacuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46653 - RNA, 1413 nt, Artificial Sequence
  neuraminidase__InfluenzaA__ABW39930
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugaggacacaagagucugaaugugucugugugaacgggucauguuucaccauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46654 - RNA, 1413 nt, Artificial Sequence
  neuraminidase__InfluenzaA__ABW39952
augaauccaaaucaaaaaauaauaaccauuggaucaaucaguauaacaaucgggauaauuagucuaauguugcaaauaggaaauauuauuucaauaugggcuagucacucaauccaaacuggaagucaaaaccacacuggaaugugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46655 - RNA, 1413 nt, Artificial Sequence; identical to SEQ ID NO: 46557
  neuraminidase__InfluenzaA__ABW39963

SEQ ID NO: 46656 - RNA, 1413 nt, Artificial Sequence; identical to SEQ ID NO: 46551
  neuraminidase__InfluenzaA__ABW39985

SEQ ID NO: 46657 - RNA, 1413 nt, Artificial Sequence
  neuraminidase__InfluenzaA__ABW39996
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaauuaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaaugggaccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucagcauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46658 - RNA, 1413 nt, Artificial Sequence; identical to SEQ ID NO: 46537
  neuraminidase__InfluenzaA__ABW40007

SEQ ID NO: 46659 - RNA, 1413 nt, Artificial Sequence
  neuraminidase__InfluenzaA__ABW40018
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaauuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauggugauacugcaaacuggucuuggccagacggugcugaguugccguucaccauugacaaauag

SEQ ID NO: 46660 - RNA, 1410 nt, Artificial Sequence; identical to SEQ ID NO: 46553
  neuraminidase__InfluenzaA__ABW40029

SEQ ID NO: 46661 - RNA, 1413 nt, Artificial Sequence
  neuraminidase__InfluenzaA__ABW40040
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaaaguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguauuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46662 - RNA, 1413 nt, Artificial Sequence
  neuraminidase__InfluenzaA__ABW40051
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46663 - RNA, 1413 nt, Artificial Sequence; identical to SEQ ID NO: 46535
  neuraminidase__InfluenzaA__ABW40062

SEQ ID NO: 46664 - RNA, 1410 nt, Artificial Sequence
  neuraminidase__InfluenzaA__ABW40084
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46665 - RNA, 1413 nt, Artificial Sequence
  neuraminidase__InfluenzaA__ABW40095
augaauccaaaucaaaaaauaauaaccauuggaucaaucaguguagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucauacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccaaugacuguugauggagcagacgggguuaagggguuuucauacaaauaugguaaugguguuuggauaggaagaacuaaaaguaacaggcuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46666 - RNA, 1413 nt, Artificial Sequence
  neuraminidase__InfluenzaA__ABW40106
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucuguuugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugguuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46667 - RNA, 1413 nt, Artificial Sequence
  neuraminidase__InfluenzaA__ABW40117
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccacuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46668 - RNA, 1413 nt, Artificial Sequence; identical to SEQ ID NO: 46537
  neuraminidase__InfluenzaA__ABW40128

SEQ ID NO: 46669 - RNA, 1410 nt, Artificial Sequence; identical to SEQ ID NO: 46553
  neuraminidase__InfluenzaA__ABW40139

SEQ ID NO: 46670 - RNA, 1413 nt, Artificial Sequence; identical to SEQ ID NO: 46540
  neuraminidase__InfluenzaA__ABW40150

SEQ ID NO: 46671 - RNA, 1413 nt, Artificial Sequence
  neuraminidase__InfluenzaA__ABW40161
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaauagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46672 - RNA, 1410 nt, Artificial Sequence
  neuraminidase__InfluenzaA__ABW40172
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugacaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46673 - RNA, 1413 nt, Artificial Sequence; identical to SEQ ID NO: 46544
  neuraminidase__InfluenzaA__ABW40183

SEQ ID NO: 46674 - RNA, 1410 nt, Artificial Sequence
  neuraminidase__InfluenzaA__ABW40194
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguggauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46675 - RNA, 1413 nt, Artificial Sequence
  neuraminidase__InfluenzaA__ABW40205
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuuggguaucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugacacugcaaacuggucuuggccagacggugcugaguugccguucaccauugacaaauag

SEQ ID NO: 46676 - RNA, 1413 nt, Artificial Sequence; identical to SEQ ID NO: 46573
  neuraminidase__InfluenzaA__ABW40216

SEQ ID NO: 46677 - RNA, 1413 nt, Artificial Sequence; identical to SEQ ID NO: 46573
  neuraminidase__InfluenzaA__ABW40227

SEQ ID NO: 46678 - RNA, 1413 nt, Artificial Sequence; identical to SEQ ID NO: 46591
  neuraminidase__InfluenzaA__ABW40238

SEQ ID NO: 46679 - RNA, 1410 nt, Artificial Sequence
  neuraminidase__InfluenzaA__ABW40249
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46680 - RNA, 1413 nt, Artificial Sequence; identical to SEQ ID NO: 46537
  neuraminidase__InfluenzaA__ABW40260

SEQ ID NO: 46681 - RNA, 1410 nt, Artificial Sequence
  neuraminidase__InfluenzaA__ABW40271
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaacacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46682 - RNA, 1413 nt, Artificial Sequence
  neuraminidase__InfluenzaA__ABW40282
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcagaaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46683 - RNA, 1413 nt, Artificial Sequence
  neuraminidase__InfluenzaA__ABW40293
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacacuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaauuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugacacugcaaacuggucuuggccagacggugcugaguugccguucaccauugacaaauag

SEQ ID NO: 46684 - RNA, 1413 nt, Artificial Sequence
  neuraminidase__InfluenzaA__ABW40304
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggggauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucggguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46685 - RNA, 1413 nt, Artificial Sequence
  neuraminidase__InfluenzaA__ABW40315
augaauccaaaucaaaaaauaauaaccauuggaucaaucaguauagcaaucggaauaauuagccuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggggauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucggguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46686 - RNA, 1410 nt, Artificial Sequence; identical to SEQ ID NO: 46553
  neuraminidase__InfluenzaA__ABW40326

SEQ ID NO: 46687 - RNA, 1413 nt, Artificial Sequence
  neuraminidase__InfluenzaA__ABW40337
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagagccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacaggcuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46688 - RNA, 1413 nt, Artificial Sequence
  neuraminidase__InfluenzaA__ABW40359
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauaccacaaucuggacuagugggagcagcauuucuuuuuguggcguugauagugacacugcaaacuggucuuggccagacggugcugaguugccguucaccauugacaaauag

SEQ ID NO: 46689 - RNA, 1413 nt, Artificial Sequence
  neuraminidase__InfluenzaA__ABW40370
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacuccggcacagugauguguguaugcagggacaacuggcaugguucaaaucgaccuugggugucuuuuaaucaaaacuuggauuaucaaauaggauacaucugcaguggaguguucggugacaauccgcgucccaaggauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuuccuuuuguggcguugauagugauacugcaaacuggucuuggccagacggugcugaguugccguucaccauugacaaguag

SEQ ID NO: 46690 - RNA, 1413 nt, Artificial Sequence; identical to SEQ ID NO: 46537
  neuraminidase__InfluenzaA__ABW40403

SEQ ID NO: 46691 - RNA, 1413 nt, Artificial Sequence
  neuraminidase__InfluenzaA__ABW40414
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucauacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuugaucaaaacuuggauuaucaaauaggauacaucugcaguggaguguucggugacaauccgcgucccaaagauggaaaaggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46692 - RNA, 1413 nt, Artificial Sequence; identical to SEQ ID NO: 46537
  neuraminidase__InfluenzaA__ABW40425

SEQ ID NO: 46693 - RNA, 1413 nt, Artificial Sequence; identical to SEQ ID NO: 46585
  neuraminidase__InfluenzaA__ABW40436

SEQ ID NO: 46694 - RNA, 1413 nt, Artificial Sequence
  neuraminidase__InfluenzaA__ABW40447
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauugaacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46695 - RNA, 1413 nt, Artificial Sequence; identical to SEQ ID NO: 46624
  neuraminidase__InfluenzaA__ABW40458

SEQ ID NO: 46696 - RNA, 1413 nt, Artificial Sequence; identical to SEQ ID NO: 46606
  neuraminidase__InfluenzaA__ABW40469

SEQ ID NO: 46697 - RNA, 1413 nt, Artificial Sequence
  neuraminidase__InfluenzaA__ABW40491
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguagcuguacuaaaauacaacggaauaauaacugaaaccauaaaaaguuggaaaaagcgaauauugagaacacaagagucugaaugugucugugugaacgggucauguuucaccauaaugaccgauggcccgaguaauggagccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46698 - RNA, 1413 nt, Artificial Sequence; identical to SEQ ID NO: 46606
  neuraminidase__InfluenzaA__ABW40502

SEQ ID NO: 46699 - RNA, 1413 nt, Artificial Sequence
  neuraminidase__InfluenzaA__ABW40513
augaauccaaaucaaaaaauaauaaccauuggaucaaucaguauagcaaucggaauaauuagucugauguugcaaauaggaaauauuauuucaauaugggcuagucacucaauccaaacuggaagucaaaaccacacuggaauaugcaaccaaagaaucauaacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcacuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuaccaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46700 - RNA, 1413 nt, Artificial Sequence; identical to SEQ ID NO: 46610
  neuraminidase__InfluenzaA__ABW40524

SEQ ID NO: 46701 - RNA, 1413 nt, Artificial Sequence
  neuraminidase__InfluenzaA__ABW40546
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcggauauugagaacacaagagucugaaugugucugugugaacgggucuuguuucaccauaaugaccgauggcccgaguaauggggccgccucguacaaaaucuucaagaucgaaaagggaaagguuacuaaaucaauggaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacauaugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46702 - RNA, 1413 nt, Artificial Sequence; identical to SEQ ID NO: 46684
  neuraminidase__InfluenzaA__ABW40557

SEQ ID NO: 46703 - RNA, 1413 nt, Artificial Sequence
  neuraminidase__InfluenzaA__ABW40568
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccucgagaaaauacaacaaucuggacuagugggagcagcauuucuuuuuguggcguugauagugauacugcaaacuggucuuggccagacggugcugaguugccguucaccauugacaaguag

SEQ ID NO: 46704 - RNA, 1413 nt, Artificial Sequence
  neuraminidase__InfluenzaA__ABW40579
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuuuaccauaaugaccgauggcccgaauaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46705 - RNA, 1413 nt, Artificial Sequence
  neuraminidase__InfluenzaA__ABW40601
augaauccaaaucaaaaaauaauaaccauuggaucaaucaguauagcaaucggaguaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaauuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcgauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauggugauacugcaaacuggucuuggccagacggugcugaguugccguucaccauugacaaauag

SEQ ID NO: 46706 - RNA, 1413 nt, Artificial Sequence
  neuraminidase__InfluenzaA__ABW40612
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46707 - RNA, 1413 nt, Artificial Sequence; identical to SEQ ID NO: 46540
  neuraminidase__InfluenzaA__ABW40623

SEQ ID NO: 46708 - RNA, 1410 nt, Artificial Sequence
  neuraminidase__InfluenzaA__ABW40634
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46709 - RNA, 1413 nt, Artificial Sequence; identical to SEQ ID NO: 46537
  neuraminidase__InfluenzaA__ABW40645

SEQ ID NO: 46710 - RNA, 1410 nt, Artificial Sequence
  neuraminidase__InfluenzaA__ABW40656
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcuggugggggcaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46711 - RNA, 1413 nt, Artificial Sequence
  neuraminidase__InfluenzaA__ABW40667
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuaccaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46712 - RNA, 1413 nt, Artificial Sequence; identical to SEQ ID NO: 46560
  neuraminidase__InfluenzaA__ABW40678

SEQ ID NO: 46713 - RNA, 1413 nt, Artificial Sequence
  neuraminidase__InfluenzaA__ABW71297
augaauccaaaucaaaaaauaauaaccauuggaucaaucaguauagcaauuggaauaauuaguuuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugacacugcaaacuggucuuggccagacggugcugaguugccguucaccauugacaaauag

SEQ ID NO: 46714 - RNA, 1413 nt, Artificial Sequence; identical to SEQ ID NO: 46585
  neuraminidase__InfluenzaA__ABW71308

SEQ ID NO: 46715 - RNA, 1413 nt, Artificial Sequence; identical to SEQ ID NO: 46537
  neuraminidase__InfluenzaA__ABW71319

SEQ ID NO: 46716 - RNA, 1413 nt, Artificial Sequence; identical to SEQ ID NO: 46566
  neuraminidase__InfluenzaA__ABW71330

SEQ ID NO: 46717 - RNA, 1413 nt, Artificial Sequence
  neuraminidase__InfluenzaA__ABW71341
augaauccaaaucaaaaaauaauaaccauuggaucuaucaguauagcgaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagccccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaauuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggcuaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46718 - RNA, 1410 nt, Artificial Sequence; identical to SEQ ID NO: 46561
  neuraminidase__InfluenzaA__ABW71352

SEQ ID NO: 46719 - RNA, 1413 nt, Artificial Sequence; identical to SEQ ID NO: 46585
  neuraminidase__InfluenzaA__ABW71363

SEQ ID NO: 46720 - RNA, 1413 nt, Artificial Sequence
  neuraminidase__InfluenzaA__ABW71374
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46721 - RNA, 1413 nt, Artificial Sequence; identical to SEQ ID NO: 46537
  neuraminidase__InfluenzaA__ABW71385

SEQ ID NO: 46722 - RNA, 1413 nt, Artificial Sequence
  neuraminidase__InfluenzaA__ABW71396
augaauccaaaucaaaaaauaauaaccauuggaucaaucaguauagcaauuggaauaauuagucuaauguugcaaauaggaaauauuauuucaauaugggcuagucacucaguccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcugcccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacggaucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46723 - RNA, 1413 nt, Artificial Sequence
  neuraminidase__InfluenzaA__ABW71407
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaaauuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugacacugcaaacuggucuuggccagacggugcugaguugccguucaccauugacaaauag

SEQ ID NO: 46724 - RNA, 1413 nt, Artificial Sequence; identical to SEQ ID NO: 46720
  neuraminidase__InfluenzaA__ABW71418

SEQ ID NO: 46725 - RNA, 1413 nt, Artificial Sequence; identical to SEQ ID NO: 46537
  neuraminidase__InfluenzaA__ABW71440

SEQ ID NO: 46726 - RNA, 1413 nt, Artificial Sequence; identical to SEQ ID NO: 46552
  neuraminidase__InfluenzaA__ABW71451

SEQ ID NO: 46727 - RNA, 1413 nt, Artificial Sequence; identical to SEQ ID NO: 46706
  neuraminidase__InfluenzaA__ABW71462

SEQ ID NO: 46728 - RNA, 1410 nt, Artificial Sequence; identical to SEQ ID NO: 44870
  neuraminidase__InfluenzaA__ABW80980

SEQ ID NO: 46729 - RNA, 1410 nt, Artificial Sequence; identical to SEQ ID NO: 44675
  neuraminidase__InfluenzaA__ABW80981

SEQ ID NO: 46730 - RNA, 1413 nt, Artificial Sequence
  neuraminidase__InfluenzaA__ABW81474
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaaaaaucauuacauaugaaaauagaaccuggguaaaucaaacauauguuaauuuuaacaacacuaauguuguugcuggaaaggacaaacccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucuuggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuacccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46731 - RNA, 1413 nt, Artificial Sequence
  neuraminidase__InfluenzaA__ABW81475
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaagacaaaaguucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccgucuccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucugugugaacgggucauguuucaccauaaugaccgauggcccgaguaauggggcugccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucauugaaacaggauguuguggcaauaacugauuggucaggguacagcggaaguuucguucaacauccugaguuaacaggauuggacuguauaagaccuugcuucuggguugaguuagucagaggacugccaagagaaaauacaacaaucuggacuagugggagcagcauuucuuuuuguggcguuaauagugauacugcaaacuggucuuggccagacggugcugaguugccguucaccauugacaaguag

SEQ ID NO: 46732 - RNA, 1413 nt, Artificial Sequence
  neuraminidase__InfluenzaA__ABW81477
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucggugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgcuucguacaaaaucuucaagaucgaaaagggaaagguuacuaaaucaauagaguugagugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggccagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 46733 - RNA, 1413 nt, Artificial Sequence
  neuraminidase__InfluenzaA__ABW81478
augaauccaaaucaaaaaauaauaaccauuggaucaaucaguauagcaaucggaauaauuagccuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuuuauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaaaaucgaaaaggggaagguuacuaaaucaauagaguugaaugcacccaauuuucauuaugaggaauguuccuguuacccagacacuggcacagugauguguguaugcagggacaacuggcaugguucaaaucgaccuuggguguccuuuaaucaaaaccuggauuaccaaauaggauacaucugcagugggguuuucggugacaauccgcgucccaaagauggagagggcagcuguaauccagugacuguugauggagcagacggaguaaagggguuuucauacaaauaugguaaugguguuuggauaggaaggacuaaaaauaacagacuuagaaagggguuugagaugauuugggauccuaauggauggacagauaccgacagugauuucucagugaaacaggauguuguggcaauaacugauuggucaggguacagcgggaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugacacugcaaacuggucuuggccagacggugcugaguugccguucaccauugacaaguag

SEQ ID NO: 46734 - RNA, 1413 nt, Artificial Sequence
  neuraminidase__InfluenzaA__ABW81479
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaaaaaucauuacauaugaaaauagaaccuggguaaaucaaacauauguuaauauuaacaacacuaauguuguugcuggaaaggacaaacccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuacccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaauaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46735 - RNA, 1413 nt, Artificial Sequence
  neuraminidase__InfluenzaA__ABW81480
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucggugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagucccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaagagucugaaugugucugugugaacgggucauguuucaccauaaugaccgauggcccgaguaauggggccgcuucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguag

SEQ ID NO: 46736 - RNA, 1413 nt, Artificial Sequence
  neuraminidase__InfluenzaA__ABW81481
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaaaaaucauuacauaugaaaauagaaccuggguaaaucaaacauauguuaauauuaacaacacuaauguuguugcuggaaaggacaaacccucgaugacauuggcaggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucugggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuacccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46737 - RNA, 1413 nt, Artificial Sequence
  neuraminidase__InfluenzaA__ABW81482
augaauccaaaucaaaaaauaauaaccauuggaucaaucaguguggcaaucggaauaauuagucuaauauugcaaauaggaaauauuauuucaauaugggcuagccacucaauccaaacuggaagucaaaacuacacuggaauaugcaaccaaaaaaucauuacauaugaaaauagaaccuggguaaaucaaacauauguuaauauuaacaacacuaauguuguugcuggaaaggacaaacccucgaugacauuggccggcaauucaucucuuugcccuauccguggaugggcaauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccauuaaggacagaagcccuuuuagggccuuaaugagcuguccucuuggugaagcuccgucuccauacaauucaagauuugaaucaguugcuuggucagcaagcgcaugccaugauggccugggcuggcuaacaaucggaauuucugguccagauaauggagcaguggcuguacuaaaauacaacggcauaauaacugaaaccauaaaaaguuggaaaaagcaaauccuaagaacacaagagucugaaugugucugugugaacgguucauguuuuaccauaaugaccgauggcccgaguaacagggccgcaucguacagaaucuucaaaauugagaaggggagaguuacuaaaucaauagaguuggaugcacccaauuaucauuacgaggaauguuccuguuacccagacaccggcacaguaaugugugugugcagggacaauuggcacgguucaaaucgaccuuggguguccuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacuaagaaagggauuugagaugauuugggauccuaauggauggacagauaccgacagugauuucucaaugaaacaggaugucguggcaaugacugauuggucaggguacagcggaaguuuuguucaacauccugagcuaacaggauuggccuguaugagaccuugcuucuggguugaauuagucagagggcuaccuagagaaaauacaacaaucuggacuagugggagcagcauuucuuuuuguggcgugaauagcgagacugcaaacuggucuuggccagacggugcugaguugccauucaccauugacaaguag

SEQ ID NO: 46738 - RNA, 1413 nt, Artificial Sequence
  neuraminidase__InfluenzaA__ABW81483
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccauccccauacaauucaaaguuugaaucaguugcauggucagcaagcgcaugccacgauggcaugggcugguuaacaaucggaauuucugguccagacaauggagcuguggcaguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46739 - RNA, 1413 nt, Artificial Sequence
  neuraminidase__InfluenzaA__ABW81484
augaauccaaaucaaaaaauaauaaccauuggaucaaucaguauagcaaucggaauaauuagucuaauguugcaaauaggaaauauuauuucaauaugggcuagucacucaauccaaacuggaaaucaaaaccacacuggaauaugcaaccaaagaaucaucacauaugaaaacagcaccugggugaaucacacauauguuaauauuaacaacacuaauguuguugcuggaaagggcaaaacuucagugacauuggccggcaauucaucucuuuguucuaucaguggaugggcuauauacacaaaagacaauagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46740 - RNA, 1413 nt, Artificial Sequence
  neuraminidase__InfluenzaA__ABW81487
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucuguguaaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucauucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46741 - RNA, 1413 nt, Artificial Sequence
  neuraminidase__InfluenzaA__ABW81488
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46742 - RNA, 1413 nt, Artificial Sequence
  neuraminidase__InfluenzaA__ABW81489
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46743 - RNA, 1413 nt, Artificial Sequence
  neuraminidase__InfluenzaA__ABW81490
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46744 - RNA, 1413 nt, Artificial Sequence
  neuraminidase__InfluenzaA__ABW81491
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguugggaaaagcgaauauugagaacacaagagucugaaugugucugugugaacgggucauguuucaccauaaugaccgauggcccaaguaauggggccgccucguacaaaaucuucaagaucgaaaagggaaagguuacuaaaucaauagaguuaaaugcacccaauuuucauuaugaggaauguuccuguuacccagacacuggcacaguaauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46745 - RNA, 1413 nt, Artificial Sequence
  neuraminidase__InfluenzaA__ABW81492
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucugggcuagugggagcagcauuucuuuuuguggcguugauagugauacugcaaacuggucuuggccagacggugcugaguugccguucaccauugacaaguag

SEQ ID NO: 46746 - RNA, 1413 nt, Artificial Sequence; identical to SEQ ID NO: 46741
  neuraminidase__InfluenzaA__ABW81493

SEQ ID NO: 46747 - RNA, 1413 nt, Artificial Sequence
  neuraminidase__InfluenzaA__ABW81494
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46748 - RNA, 1413 nt, Artificial Sequence
  neuraminidase__InfluenzaA__ABW81495
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggagugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46749 - RNA, 1413 nt, Artificial Sequence
  neuraminidase__InfluenzaA__ABW81497
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguugggaaaaacgaauauugagaacacaagagucugaaugugucugugugaacgggucauguuucaccauaaugaccgauggcccaaguaauggggccgccucguacaaaaucuucaagaucgaaaagggaaagguuacuaaaucaauagaguuaaaugcacccaauuuucauuaugaggaauguuccuguuacccagacacuggcacaguaauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46750 - RNA, 1413 nt, Artificial Sequence
  neuraminidase__InfluenzaA__ABW81498
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguugggaaaagcgaauauugagaacacaagagucugaaugugucugugugaacgggucauguuucaccauaaugaccgauggcccaaguaauggggccgccucguacaaaaucuucaagaucgaaaagggaaagguuacuaaaucaauagaguuaaaugcacccaauuuucauuaugaggaauguuccuguuacccagacacuggcacaguaauguguguaugcagggacaacuggcaugguucaaaucgaccuugggugucuuuuaaucaaaacuuggauuaucaaguaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46751 - RNA, 1413 nt, Artificial Sequence
  neuraminidase__InfluenzaA__ABW81499
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaagggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccacgauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgaugguccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46752 - RNA, 1413 nt, Artificial Sequence
  neuraminidase__InfluenzaA__ABW81500
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagugcaugccaugauggcaugggcugguuaacaaucggaauuucugguccagacaauggagcuguggcuguacuaaaguacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacugcugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46753 - RNA, 1413 nt, Artificial Sequence
  neuraminidase__InfluenzaA__ABW81501
augaauccaaaucaaaaaauaauaaccauuggaucaaucaguauagcaaucggaauaauuagucuaauguugcaaauagggaauauuauuucaauaugggcuagucacucaauccaaacuggaagucaaaaccacacuggaauaugcaaccaaaaaaucaucacauaugagaacagcaccugggugaaucacacauauguuaauauuaacaacacuaauguuguugcuggaaaggacaaaacuucagugacauuggccggcaauucaucucuuuguucugucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagugcaugucaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguauucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggauacaguggaaguuucguucaacauccugaauuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46754 - RNA, 1413 nt, Artificial Sequence; identical to SEQ ID NO: 46585
  neuraminidase__InfluenzaA__ABW86324

SEQ ID NO: 46755 - RNA, 1413 nt, Artificial Sequence; identical to SEQ ID NO: 46620
  neuraminidase__InfluenzaA__ABW86335

SEQ ID NO: 46756 - RNA, 1413 nt, Artificial Sequence; identical to SEQ ID NO: 46537
  neuraminidase__InfluenzaA__ABW86346

SEQ ID NO: 46757 - RNA, 1413 nt, Artificial Sequence
  neuraminidase__InfluenzaA__ABW86357
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggacauuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46758 - RNA, 1413 nt, Artificial Sequence; identical to SEQ ID NO: 46619
  neuraminidase__InfluenzaA__ABW86368

SEQ ID NO: 46759 - RNA, 1413 nt, Artificial Sequence
  neuraminidase__InfluenzaA__ABW86379
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauaugucaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46760 - RNA, 1413 nt, Artificial Sequence; identical to SEQ ID NO: 46535
  neuraminidase__InfluenzaA__ABW86390

SEQ ID NO: 46761 - RNA, 1413 nt, Artificial Sequence; identical to SEQ ID NO: 46711
  neuraminidase__InfluenzaA__ABW86401

SEQ ID NO: 46762 - RNA, 1413 nt, Artificial Sequence
  neuraminidase__InfluenzaA__ABW86412
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaagacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46763 - RNA, 1413 nt, Artificial Sequence
  neuraminidase__InfluenzaA__ABW86423
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaagagucugaaugugucugugugaacgggucauguuucgccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46764 - RNA, 1413 nt, Artificial Sequence; identical to SEQ ID NO: 46537
  neuraminidase__InfluenzaA__ABW86434

SEQ ID NO: 46765 - RNA, 1413 nt, Artificial Sequence
  neuraminidase__InfluenzaA__ABW86445
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaggagucugaaugugucugugugaaugggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46766 - RNA, 1413 nt, Artificial Sequence
  neuraminidase__InfluenzaA__ABW86456
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauaugucaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacugguccuggccagacggugcugaguugccguucaccauugacaaauag

SEQ ID NO: 46767 - RNA, 1413 nt, Artificial Sequence
  neuraminidase__InfluenzaA__ABW86467
augaauacaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucaauuaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46768 - RNA, 1413 nt, Artificial Sequence; identical to SEQ ID NO: 46706
  neuraminidase__InfluenzaA__ABW86478

SEQ ID NO: 46769 - RNA, 1413 nt, Artificial Sequence
  neuraminidase__InfluenzaA__ABW86489
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguugugggaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46770 - RNA, 1413 nt, Artificial Sequence
  neuraminidase__InfluenzaA__ABW86500
augaauccaaaucaaaaaauaaugaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagagccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacaggcuuagaaagggguuugagaugauuugggauccuaauggauggacaaauaccgacagugauuucucaaugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46771 - RNA, 1413 nt, Artificial Sequence; identical to SEQ ID NO: 46606
  neuraminidase__InfluenzaA__ABW86511

SEQ ID NO: 46772 - RNA, 1413 nt, Artificial Sequence
  neuraminidase__InfluenzaA__ABW86522
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugacugauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaguaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46773 - RNA, 1413 nt, Artificial Sequence
  neuraminidase__InfluenzaA__ABW86533
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucauacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46774 - RNA, 1413 nt, Artificial Sequence; identical to SEQ ID NO: 46706
  neuraminidase__InfluenzaA__ABW86544

SEQ ID NO: 46775 - RNA, 1413 nt, Artificial Sequence; identical to SEQ ID NO: 46537
  neuraminidase__InfluenzaA__ABW86555

SEQ ID NO: 46776 - RNA, 1410 nt, Artificial Sequence
  neuraminidase__InfluenzaA__ABW86566
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaguaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46777 - RNA, 1413 nt, Artificial Sequence; identical to SEQ ID NO: 46624
  neuraminidase__InfluenzaA__ABW86609

SEQ ID NO: 46778 - RNA, 1413 nt, Artificial Sequence; identical to SEQ ID NO: 45563
  neuraminidase__InfluenzaA__ABW91188

SEQ ID NO: 46779 - RNA, 1410 nt, Artificial Sequence
  neuraminidase__InfluenzaA__ABW91210
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugauacugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46780 - RNA, 1413 nt, Artificial Sequence; identical to SEQ ID NO: 46551
  neuraminidase__InfluenzaA__ABW91221

SEQ ID NO: 46781 - RNA, 1410 nt, Artificial Sequence
  neuraminidase__InfluenzaA__ABW91232
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaucaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46782 - RNA, 1410 nt, Artificial Sequence; identical to SEQ ID NO: 46582
  neuraminidase__InfluenzaA__ABW91243

SEQ ID NO: 46783 - RNA, 1410 nt, Artificial Sequence
  neuraminidase__InfluenzaA__ABW91254
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaaugugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46784 - RNA, 1410 nt, Artificial Sequence; identical to SEQ ID NO: 46674
  neuraminidase__InfluenzaA__ABW91265

SEQ ID NO: 46785 - RNA, 1413 nt, Artificial Sequence; identical to SEQ ID NO: 46540
  neuraminidase__InfluenzaA__ABW91276

SEQ ID NO: 46786 - RNA, 1413 nt, Artificial Sequence
  neuraminidase__InfluenzaA__ABW91287
augaacccaaaucaaaaaauaauaaccauuggaucaaucaguauagcaaucggaauaauuagucuaauauugcaaauaggaaauauuauuucaauaugggcuagccacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauauuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaacuauaaaaaguuggaaaaagcgaauauuaagaacacaagagucugaauguguuuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgccccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauauuguagcaauaacugauuggucaggguacagcggaaguuuuguucaacauccugaguuaacaggguuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 46787 - RNA, 1413 nt, Artificial Sequence; identical to SEQ ID NO: 46648
  neuraminidase__InfluenzaA__ABW91298

SEQ ID NO: 46788 - RNA, 1413 nt, Artificial Sequence
  neuraminidase__InfluenzaA__ABW91309
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacugcugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46789 - RNA, 1413 nt, Artificial Sequence; identical to SEQ ID NO: 46552
  neuraminidase__InfluenzaA__ABW91320

SEQ ID NO: 46790 - RNA, 1413 nt, Artificial Sequence; identical to SEQ ID NO: 46537
  neuraminidase__InfluenzaA__ABW91331

SEQ ID NO: 46791 - RNA, 1413 nt, Artificial Sequence; identical to SEQ ID NO: 46639
  neuraminidase__InfluenzaA__ABW91342

SEQ ID NO: 46792 - RNA, 1413 nt, Artificial Sequence
  neuraminidase__InfluenzaA__ABW91353
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugaccuuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaauuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcugcaauccagugacuguugauggagcagacgggguuaagggguuuucauacaaauaugguaaugguguuuggauaggaagaacuaaaaguaacagacuuagaaagggguucgagaugauuugggaucccaauggauggacagauaccgacagugauuucucaguuaaacaggauguuguagcaauaacugauuggucaggguacaguggaaguuucguucaacauccugaguuaacaggauuggacuguauaagaccuugcuucuggguugaguuagucagaggacugcccagagaaaauacaacaaucuggacuagugggagcagcauuucuuuuuguggcguugauagugauacugcaaacuggucuuggccagacggugcugaguugccguucacuauugacaaguag

SEQ ID NO: 46793 - RNA, 1413 nt, Artificial Sequence
  neuraminidase__InfluenzaA__ABW91364
augaauacaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguuacuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucacuauaaugaccgauggcccgagugauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacaaacuuagaaagggguuugagaugauuugggauccuaauggauggacagauaccgacaaugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46794 - RNA, 1413 nt, Artificial Sequence; identical to SEQ ID NO: 46535
  neuraminidase__InfluenzaA__ABW91375

SEQ ID NO: 46795 - RNA, 1413 nt, Artificial Sequence
  neuraminidase__InfluenzaA__ABW91386
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucguacaaauaugguaaugguguuuggauaggaaggacuaaaaguaacaaacuuagaaagggguuugaaaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46796 - RNA, 1410 nt, Artificial Sequence
  neuraminidase__InfluenzaA__ABW91397
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcauuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaaguuauugaaggcugguccaacccuaaguccaaauugcagauaaauaggcaagucauaguugacagagguaauaggucagguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 46797 - RNA, 1413 nt, Artificial Sequence
  neuraminidase__InfluenzaA__ABW91408
augaauccaaaucaaaaaauaauaaccauuggaucaaucaguauagcaaucggaguaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucuguaguggaguguucggugacaauccgcgucccaaagauggaaagggcagcuguaauccagugacuguugauggagcagacggaauuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcgauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauggugauacugcaaacuggucuuggccagacggugcugaguugccguucaccauugacaaauag

SEQ ID NO: 46798 - RNA, 1413 nt, Artificial Sequence
  neuraminidase__InfluenzaA__ABW91419
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46799 - RNA, 1413 nt, Artificial Sequence
  neuraminidase__InfluenzaA__ABW91430
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggaucuguggcuguacuaaaauacaacggaauaauaacugaaaccauaaaaaguuggaaaaagcgaauauugagaacacaggagucugaaugugucugugugaacgggucauguuucaccauaaugaccgaugguccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugacacugcaaacuggucuuggccagacggugcugaguugccguucaccauugacaaauag

SEQ ID NO: 46800 - RNA, 1410 nt, Artificial Sequence; identical to SEQ ID NO: 46674
  neuraminidase__InfluenzaA__ABW91441

SEQ ID NO: 46801 - RNA, 1413 nt, Artificial Sequence
  neuraminidase__InfluenzaA__ABW91452
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuaccaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggauugccuagagaaaauacaacaaucuggacuagugggagcagcauuucuuuuuguggcguugauagugauacugcaaacuggucuuggccagacggugcugaguugccguucaccauugacaaauag

SEQ ID NO: 46802 - RNA, 1413 nt, Artificial Sequence; identical to SEQ ID NO: 46585
  neuraminidase__InfluenzaA__ABW91463

SEQ ID NO: 46803 - RNA, 1413 nt, Artificial Sequence; identical to SEQ ID NO: 46535
  neuraminidase__InfluenzaA__ABW91474

SEQ ID NO: 46804 - RNA, 1413 nt, Artificial Sequence; identical to SEQ ID NO: 46711
  neuraminidase__InfluenzaA__ABW91485

SEQ ID NO: 46805 - RNA, 1413 nt, Artificial Sequence; identical to SEQ ID NO: 46537
  neuraminidase__InfluenzaA__ABW91496

SEQ ID NO: 46806 - RNA, 1413 nt, Artificial Sequence; identical to SEQ ID NO: 46720
  neuraminidase__InfluenzaA__ABW91507

SEQ ID NO: 46807 - RNA, 1413 nt, Artificial Sequence
  neuraminidase__InfluenzaA__ABW91518
augaauccaaaucaaaaaauaauaaccauuggaucaaucaguauagcaaucggaauaauuagucuaauguugcaaauaggaaacauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggauacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46808 - RNA, 1413 nt, Artificial Sequence
  neuraminidase__InfluenzaA__ABW91529
augaauccaaaucaaaaaauaauaaccauuggaucaaucaguauagcaaucgggacaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccauuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46809 - RNA, 1413 nt, Artificial Sequence
  neuraminidase__InfluenzaA__ABW91540
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccuggaugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46810 - RNA, 1410 nt, Artificial Sequence
  neuraminidase__InfluenzaA__ABW91551
augaauccaaaucaaaagauaauaacgauuggcucuguuucucucaccauuuccacaauaugcuucuucaugcaaauugccaucuugauaacuacuguaacauugcauuucaagcaauaugaauucaacuuccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugccacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46811 - RNA, 1413 nt, Artificial Sequence; identical to SEQ ID NO: 46537
  neuraminidase__InfluenzaA__ABW91562

SEQ ID NO: 46812 - RNA, 1413 nt, Artificial Sequence; identical to SEQ ID NO: 46706
  neuraminidase__InfluenzaA__ABW91584

SEQ ID NO: 46813 - RNA, 1413 nt, Artificial Sequence; identical to SEQ ID NO: 46537
  neuraminidase__InfluenzaA__ABW91595

SEQ ID NO: 46814 - RNA, 1413 nt, Artificial Sequence; identical to SEQ ID NO: 46585
  neuraminidase__InfluenzaA__ABW91606

SEQ ID NO: 46815 - RNA, 1413 nt, Artificial Sequence; identical to SEQ ID NO: 46706
  neuraminidase__InfluenzaA__ABW91617

SEQ ID NO: 46816 - RNA, 1413 nt, Artificial Sequence
  neuraminidase__InfluenzaA__ABW91628
augaauccaaaucaaaaaauaauaaccauuggaucaaucaguauagcaauagggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggaucccaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46817 - RNA, 1413 nt, Artificial Sequence; identical to SEQ ID NO: 46639
  neuraminidase__InfluenzaA__ABW91639

SEQ ID NO: 46818 - RNA, 1410 nt, Artificial Sequence
  neuraminidase__InfluenzaA__ABW91650
augaauccaaaucaaaagauaauaacgauuggcucuguuucucucaccauuuccacaauaugcuucuucaugcaaauugccaucuugauaacuacuguaacacugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46819 - RNA, 1350 nt, Artificial Sequence
  neuraminidase__InfluenzaA__ABX10517
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaauuuucuuacugagaaagcuguggcuucaguaaaauuagcgggcaauucaucucuuugccccauuaauggaugggcuguacacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaagggaaagugguuaaaucagucgaauuggaugcuccuaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggaacagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuugggcuagugggagcagcauaucuuuuugugguguaaauagugacacuguggguuggucuuggccagacggugcugaguugccauucaccauugacaaguag

SEQ ID NO: 46820 - RNA, 1410 nt, Artificial Sequence
  neuraminidase__InfluenzaA__ABX10527
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggagacuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 46821 - RNA, 1413 nt, Artificial Sequence
  neuraminidase__InfluenzaA__ABX58242
augaauccaaaucaaaaaauaauaaccauuggaucaaucaguauagcaaucgggauaauuagucuaauguugcaaauaggaaauauuauuucaauauggacuagucacucaauccaaacuggaagucaaaaccacacuggaauaugcaaccaaagaaucaucacauaugaaaacagcaccugggugaaucacacauauguuaguaucaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46822 - RNA, 1413 nt, Artificial Sequence; identical to SEQ ID NO: 46633
  neuraminidase__InfluenzaA__ABX58253

SEQ ID NO: 46823 - RNA, 1413 nt, Artificial Sequence
  neuraminidase__InfluenzaA__ABX58264
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcugacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46824 - RNA, 1413 nt, Artificial Sequence
  neuraminidase__InfluenzaA__ABX58275
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguccaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46825 - RNA, 1413 nt, Artificial Sequence
  neuraminidase__InfluenzaA__ABX58286
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaaucggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46826 - RNA, 1413 nt, Artificial Sequence
  neuraminidase__InfluenzaA__ABX58297
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaaaaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuccugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucagguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46827 - RNA, 1413 nt, Artificial Sequence; identical to SEQ ID NO: 46797
  neuraminidase__InfluenzaA__ABX58308

SEQ ID NO: 46828 - RNA, 1413 nt, Artificial Sequence
  neuraminidase__InfluenzaA__ABX58319
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccauuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucauacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46829 - RNA, 1413 nt, Artificial Sequence; identical to SEQ ID NO: 46705
  neuraminidase__InfluenzaA__ABX58352

SEQ ID NO: 46830 - RNA, 1413 nt, Artificial Sequence; identical to SEQ ID NO: 46537
  neuraminidase__InfluenzaA__ABX58363

SEQ ID NO: 46831 - RNA, 1413 nt, Artificial Sequence; identical to SEQ ID NO: 46535
  neuraminidase__InfluenzaA__ABX58385

SEQ ID NO: 46832 - RNA, 1413 nt, Artificial Sequence
  neuraminidase__InfluenzaA__ABX58396
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucagguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46833 - RNA, 1413 nt, Artificial Sequence
  neuraminidase__InfluenzaA__ABX58407
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguccuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46834 - RNA, 1413 nt, Artificial Sequence
  neuraminidase__InfluenzaA__ABX58418
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaaggucacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46835 - RNA, 1413 nt, Artificial Sequence; identical to SEQ ID NO: 46535
  neuraminidase__InfluenzaA__ABX58429

SEQ ID NO: 46836 - RNA, 1413 nt, Artificial Sequence
  neuraminidase__InfluenzaA__ABX58440
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccugacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugagcuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46837 - RNA, 1413 nt, Artificial Sequence
  neuraminidase__InfluenzaA__ABX58451
augaauccaaaucaaaaaauaauaaccauuggaucaaucaguauagcaaucgggacaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuucuguggcguugauagugauacugcaaacuggucuuggccagacggugcugaguugccguucaccauugacaaguag

SEQ ID NO: 46838 - RNA, 1413 nt, Artificial Sequence; identical to SEQ ID NO: 46699
  neuraminidase__InfluenzaA__ABX58462

SEQ ID NO: 46839 - RNA, 1413 nt, Artificial Sequence; identical to SEQ ID NO: 46684
  neuraminidase__InfluenzaA__ABX58473

SEQ ID NO: 46840 - RNA, 1413 nt, Artificial Sequence; identical to SEQ ID NO: 46699
  neuraminidase__InfluenzaA__ABX58484

SEQ ID NO: 46841 - RNA, 1413 nt, Artificial Sequence
  neuraminidase__InfluenzaA__ABX58495
augaauccaaaucaaaaaauaauaaccauuggaucuaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauagaaccguuaaggaccgaaguccuuauagggccuuaaugagcuguccucuaggugaagccccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46842 - RNA, 1413 nt, Artificial Sequence
  neuraminidase__InfluenzaA__ABX58506
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46843 - RNA, 1413 nt, Artificial Sequence; identical to SEQ ID NO: 46699
  neuraminidase__InfluenzaA__ABX58528

SEQ ID NO: 46844 - RNA, 1413 nt, Artificial Sequence
  neuraminidase__InfluenzaA__ABX58539
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcacuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagaucgaaaagggaaagguuaccaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46845 - RNA, 1413 nt, Artificial Sequence
  neuraminidase__InfluenzaA__ABX58550
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccguugacaaguag

SEQ ID NO: 46846 - RNA, 1413 nt, Artificial Sequence
  neuraminidase__InfluenzaA__ABX58561
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuuggguguccuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucagguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46847 - RNA, 1413 nt, Artificial Sequence
  neuraminidase__InfluenzaA__ABX58572
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucauacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccaaugacuguugauggagcagacgggguuaagggguuuucauacaaauaugguaaugguguuuggauaggaagaacuaaaaguaacaggcuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46848 - RNA, 1413 nt, Artificial Sequence; identical to SEQ ID NO: 46608
  neuraminidase__InfluenzaA__ABX58583

SEQ ID NO: 46849 - RNA, 1413 nt, Artificial Sequence
  neuraminidase__InfluenzaA__ABX58594
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccgguaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46850 - RNA, 1413 nt, Artificial Sequence; identical to SEQ ID NO: 46720
  neuraminidase__InfluenzaA__ABX58605

SEQ ID NO: 46851 - RNA, 1413 nt, Artificial Sequence; identical to SEQ ID NO: 46624
  neuraminidase__InfluenzaA__ABX58616

SEQ ID NO: 46852 - RNA, 1413 nt, Artificial Sequence; identical to SEQ ID NO: 46639
  neuraminidase__InfluenzaA__ABX58627

SEQ ID NO: 46853 - RNA, 1413 nt, Artificial Sequence; identical to SEQ ID NO: 46684
  neuraminidase__InfluenzaA__ABX58638

SEQ ID NO: 46854 - RNA, 1413 nt, Artificial Sequence
  neuraminidase__InfluenzaA__ABX58682
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacaaugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46855 - RNA, 1413 nt, Artificial Sequence
  neuraminidase__InfluenzaA__ABX58693
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauagggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcacgguucaaaucgaccuugggugucuuuuaaucaaaacuuggauuaucaaauaggauacaucugcaguggagugcucggugacaauccgcgucccgaagauggagagggcagcugcaauccagugacuguugauggagcagacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 46856 - RNA, 1413 nt, Artificial Sequence; identical to SEQ ID NO: 46705
  neuraminidase__InfluenzaA__ABX58704

SEQ ID NO: 46857 - RNA, 1413 nt, Artificial Sequence; identical to SEQ ID NO: 46633
  neuraminidase__InfluenzaA__ABX58715

SEQ ID NO: 46858 - RNA, 1350 nt, Artificial Sequence
  neuraminidase__InfluenzaA__ABY19420
augaauccaaaucagaaaguaauaaccauugggucaaucuguaugguaauuggaauaguuagcuuaauguugcaaauugggaacaugaucucaauaugggucagucauucaauucagacagggaaucaaaaccaaguugagccaaucaucaauacuaauuuucuuacugggaaagcuguggcuucaauaacauuagcgggcaauucaucucuuugcccuauuagaggaugggcuauacacaguaaggacaacaguauaaggauugguuccaagggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccggacaauggggcuguggcuguauugaaauacaauggcauaauaacagacaccaucaagagcuggaggaacaacauacugagaacucaagaauccgaaugugcaugcguaaauggcucuugcuuuacuguaaugacugacggaccaaguaaugggcaggcaucauauaagaucuucaaaauggaaaaggggaaaguaaucaaaucagucgaauuggaugcuccuaauuaccacuaugaggaaugcuccuguuauccugaugccggcgaaaucacaugugugugcagagauaauuggcauggcucaaaucggccauggguguccuucaaucaaaaucuggaguaucaaauaggauauauaugcaguggaguuuucggagacaauccacgccccaaugauggaacagguaguugcgguccggugucccauaauggggcauaugggguaaaaggguuuucauuuaaauacggcaaugguguuuggaucgggagaaccaaaagcccuaauuccaggagcggcuuugagaugauuugggauccaaauggguggagugaaacggacaguagcuucucggugaaacaagauauaguagcaauaacugauuggucaggauauagcgggaguuuuguccagcauccagaacugacagguuuagauugcauaagaccuuguuucuggguugaauuaaucagagggcggcccaaagagaguacaguuuggacuagugggagcagcauauccuuuugugguguaaauagugacacugugaguuggucuuggccagacggugcugaguugccauucagcauugacaaguag

SEQ ID NO: 46859 - RNA, 1350 nt, Artificial Sequence
  neuraminidase__InfluenzaA__ABY19421
augaauccaaaucagaagauaauaaccauugggucaaucuguaugguaauuggaauaguuagcuuaauguugcaaauugggaacaugaucucaauaugggucagucauucaauucagacagggaaucaaaaccaaguugagccaaucaucaauacuaauuuucuuacugggaaagcuguggcuucaauaacauuagcgggcaauucaucucuuugcccuauuagaggaugggcuauacacaguaaggacaacaguauaaggauugguuccaagggggauguguuuguuauuagagagccauucaucucaugcucccacuuggaaugcagaacuuucuuuuugacucagggagccuugcugaaugacaagcacuccaacgggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucuggcccggacaauggggcuguggcuguauugaaauacaauggcauaauaacagacaccaucaagagcuggaggaacaacauacugagaacucaagaguccgaaugugcaugcguaaauggcucuugcuuuacuguaaugacugacggaccaaguaaugggcaggcaucauauaagaucuucaaaauggaaaaggggaaaguaauuaaaucagucgaauuggaugcuccuaauuaccacuaugaggaaugcuccuguuauccugaugccggcgaaaucacaugugugugcagagauaauuggcauggcucaaaucggccauggguguccuucaaucaaaaucuggaguaucaaauaggauauauaugcaguggaguuuucggagacaauccacgccccaaugauggaacagguaguugcgguccggugucccauaauggggcauaugggguaaaaggguuuucauuuaaauacggcaaugguguuuggaucgggagaaccaaaagcccuaauuccaggagcggcuuugagaugauuugggauccaaauggguggagugaaacggacaguagcuucucggugaaacaagauauaguagcaauaacugauuggucaggauauagcgggaguuuuguccagcauccagaacugacagguuuagauugcauaagaccuuguuucuggguugaauuaaucagagggcggcccaaagagaguacaguuuggacuagugggagcagcauauccuuuugugguguaaauagugacacugugaguuggucuuggccagacggugcugaguugccauucagcauugacaaguag

SEQ ID NO: 46860 - RNA, 1413 nt, Artificial Sequence
  neuraminidase__InfluenzaA__ABY51020
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccauugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucagguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46861 - RNA, 1410 nt, Artificial Sequence
  neuraminidase__InfluenzaA__ABY51031
augaauccaaaucaaaagauaauaacaauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46862 - RNA, 1413 nt, Artificial Sequence
  neuraminidase__InfluenzaA__ABY51042
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacugggauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauagggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcagacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguugucgcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 46863 - RNA, 1413 nt, Artificial Sequence
  neuraminidase__InfluenzaA__ABY51053
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacggaucauguuucaccauaaugaccgauggcccgaguaauagggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggaacagacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 46864 - RNA, 1413 nt, Artificial Sequence
  neuraminidase__InfluenzaA__ABY51064
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaaggaucaucacauaugaaaacagcaccugggugaaucacacauauguuaauauuaacaacacuaauguuguugcuggaaaggacaaaacuucagugacacuggccggcaauucaucucuuuguucuauuaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagccccguccccauacaauucaaaguuugaaucaguugcauggucagcaagcgcaugccaugauggcaagggcugguuaacaaucggaauuucugguccagacaauggagcuguggcuguacuaaaauacaacggaauaauaacugaaaccauaaaaaguuggaacaagcaaauauugagaacacaagagucugaauguguuugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauuggauacaucugcaguggaguuuucggugacaauccgcgucccaaagauggaaggggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagucauuucucagugaaacaggauguuguggcaauaacugauuggucaggguacagcggaaguuucguccaacauccugaguuaacaggauuggacuguauaaaaccuugcuucuggguugaguuagucagaggacugccuagagaaaauacaacaaucuggacuagugggagcagcauuucuuuuuguggcguugauagugauacugcaaacuggucuuggccagacggugcugaguugccguucaucauugacaaguag

SEQ ID NO: 46865 - RNA, 1413 nt, Artificial Sequence; identical to SEQ ID NO: 46537
  neuraminidase__InfluenzaA__ABY51075

SEQ ID NO: 46866 - RNA, 1413 nt, Artificial Sequence
  neuraminidase__InfluenzaA__ABY51086
augaauccaaaucaaaaaauaauaaccauuggaucaaucaguauagcaaucggaauaauuaguauaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccuaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaauuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauggugauacugcaaacuggucuuggccagacggugcugaguugccguucaccauugacaaauag

SEQ ID NO: 46867 - RNA, 1413 nt, Artificial Sequence
  neuraminidase__InfluenzaA__ABY51097
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46868 - RNA, 1413 nt, Artificial Sequence
  neuraminidase__InfluenzaA__ABY51108
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuccugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauauuguggcaauaacugauuggucagguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46869 - RNA, 1413 nt, Artificial Sequence; identical to SEQ ID NO: 46535
  neuraminidase__InfluenzaA__ABY51119

SEQ ID NO: 46870 - RNA, 1410 nt, Artificial Sequence; identical to SEQ ID NO: 46708
  neuraminidase__InfluenzaA__ABY51130

SEQ ID NO: 46871 - RNA, 1413 nt, Artificial Sequence; identical to SEQ ID NO: 46585
  neuraminidase__InfluenzaA__ABY51141

SEQ ID NO: 46872 - RNA, 1413 nt, Artificial Sequence
  neuraminidase__InfluenzaA__ABY51152
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaacgcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguugacaggauuggacuguauaagaccuugcuucuggguugaguuagucagaggacugccuagagaaaauacaacaaucuggacuagugggagcagcauuucuuuuuguggcguuaauagugauacugcaaacuggucuuggccagacggugcugaguugccguucaccauugacaaguag

SEQ ID NO: 46873 - RNA, 1413 nt, Artificial Sequence
  neuraminidase__InfluenzaA__ABY51163
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugauauuggccggcaauucaucucuuuguucuaucaguggaugggcuauauacacaaaagacaacagcauaagaauuggcuccaaaggagauguuuuugucauaagagaaccuuucauaucauguucucauuuggaauguaggaccuuuuuucugacccaaggugcucuauuaaaugacaaacauucaaauggaaccguuaaggacagaaguccuuauagggccuuaaugagcuguccucuaggugaagcuccguccccauauaauucaaaguuugaaucaguugcauggucagcaagcgcaugccaugauggcaugggcugguuaacaaucggaauuucugguccagacaauggagcuguggcuguacuaaaauacaauggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaccaaauaggauacaucugcaguggaguguucggugacaauccgcgucccaaagauggaaagggcagcuguaauccagugacuguugauggagcagacggaguuaaaggauuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46874 - RNA, 1413 nt, Artificial Sequence
  neuraminidase__InfluenzaA__ABY51174
augaauccaaaucaaaaaaugauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46875 - RNA, 1413 nt, Artificial Sequence; identical to SEQ ID NO: 46610
  neuraminidase__InfluenzaA__ABY51185

SEQ ID NO: 46876 - RNA, 1413 nt, Artificial Sequence
  neuraminidase__InfluenzaA__ABY51196
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaaugggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46877 - RNA, 1410 nt, Artificial Sequence; identical to SEQ ID NO: 46582
  neuraminidase__InfluenzaA__ABY51229

SEQ ID NO: 46878 - RNA, 1413 nt, Artificial Sequence
  neuraminidase__InfluenzaA__ABY51240
augaauccaaaucaaaaaauaauaaccauuggaucaaucaguauagcaaucgggauaauuagucuaauguugcaaauaggaaauauuauuucaguaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggauggucuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46879 - RNA, 1413 nt, Artificial Sequence
  neuraminidase__InfluenzaA__ABY51251
augaauccaaaucaaaaaauaauaaccauuggaucaaucaguauagcaauuggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucgggauuucugguccagacaauggagcuguggcuguacuaaaauacaacggaauaauaacugaaaccauaaaaaguuggaaaaagcgaauauugagaacacaggagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggauaacuggcaugguucaaaucgaccuugggugucuuuuaaucaaaacuuggauuaucaaguaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacaaacuuagaaagggguuugagaugauuugggauccuaauggauggacagauaccgacagugauuucucagugaaacaggauguuguggcaauaaccgauuggucaggguacaguggaaguuucguucaacauccugaguuaacaggauuggacuguauaagaccuugcuucuggguugaguuaguuagaggacugccuagagaaaaugcaacaaucuggacuagugggagcagcauuucuuuuuguggcguugauagugauacugcaaacuggucuuggccagacggugcugaguugccguucaccauugacaaauag

SEQ ID NO: 46880 - RNA, 1413 nt, Artificial Sequence
  neuraminidase__InfluenzaA__ABY51262
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaaaggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaaugcaacaaucuggacuagugggagcagcauuucuuuuuguggcguugauagugauacugcaaacuggucuuggccagacggugcugaguugccguucaccauugacaaguag

SEQ ID NO: 46881 - RNA, 1410 nt, Artificial Sequence; identical to SEQ ID NO: 46553
  neuraminidase__InfluenzaA__ABY51273

SEQ ID NO: 46882 - RNA, 1350 nt, Artificial Sequence
  neuraminidase__InfluenzaA__ABY76285
augaauccaaaucagaagauaauaaccaucggaucaaucuguaugguaauuggaauaguuagcuuaauguuacaaauugggaacaugaucucaauaugggucagucauucaauucagacagggaaucaacgccaagcugaaccaaucagcaauacuaaauuucuuacugagaaagcuguggcuucaguaacauuagcgggcaauucaucucuuugccccauuagcggaugggcuguauacaguaaggacaacaguauaaggaucgguuccaagggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugaccauuggaauuucugguccagacaauggggcuguggcuguauugaaauacaauggcauaauaacagacaccaucaagaguuggaggaacaacauacugagaacccaagagucugaaugugcauguguaaauggcucuugcuuuacuguaaugacugauggaccaaguaaugggcaggcaucauauaagaucuucaaaauggaaaaagggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggauugggagaaccaaaagcacuaauuccaggagcggcuuugaaaugauuugggauccaaauggguggacuggaacggacaguagcuuuucggugaagcaagauauuguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 46883 - RNA, 1413 nt, Artificial Sequence
  neuraminidase__InfluenzaA__ABY81352
augaauccaaaucagaaaauaauaaccauuggaucaaucuguauggcaaucggaauaauuagucuaauauugcaaauagggaguauuaucucaauauggguuagccacucaauucaaacuggaagucaaaaccauacuggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagauuugaaucgguugcuuggucagcaagugcaugucaugauggcaugggcuggcuaacaaucggaauuucugguccagaugauggagcaguggcuguacuaaaauacaacggcauaauaacugagaccauaaaaaguuggaggaagcaaauauuaagaacacaagagucugaaugugucuguguaaacgguucauguuuuaccauaaugaccgauggcccgagugaugggcaggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcagcugugauccaguaaauguugauggagcagacggaguaaagggguuuucauacagguaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugcugaguugccauucaccauugacaaguag

SEQ ID NO: 46884 - RNA, 1413 nt, Artificial Sequence
  neuraminidase__InfluenzaA__ABY81363
augaauccaaaucaaaaaauaauaaccauuggaucaaucaguauagcaaucgggauaauuagucuaauguugcaaauaggaaauauuauuucaauaugggcuagucacucaauccaaauuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46885 - RNA, 1410 nt, Artificial Sequence
  neuraminidase__InfluenzaA__ABY81374
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugcccuaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuugucggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46886 - RNA, 1413 nt, Artificial Sequence; identical to SEQ ID NO: 46535
  neuraminidase__InfluenzaA__ABY81385

SEQ ID NO: 46887 - RNA, 1413 nt, Artificial Sequence
  neuraminidase__InfluenzaA__ABY81407
augaauccaaaucaaaaaauaauaaccauuggaucaaucaguauagcaaucgggacaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucuuagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46888 - RNA, 1410 nt, Artificial Sequence; identical to SEQ ID NO: 46582
  neuraminidase__InfluenzaA__ACA24505

SEQ ID NO: 46889 - RNA, 1413 nt, Artificial Sequence
  neuraminidase__InfluenzaA__ACA24516
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaagggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaagcaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46890 - RNA, 1413 nt, Artificial Sequence
  neuraminidase__InfluenzaA__ACA24527
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46891 - RNA, 1410 nt, Artificial Sequence
  neuraminidase__InfluenzaA__ACA24692
augaauccaaaucaaaagauaauaacgauuggcucuguuucucucaccauuuccacaauaugcuucuucaugcaaauugccaucuugauaacuacuguaacauugcauuucaagcaauaugaauucagcccccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaaugggacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccaaauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaugaggaaaccgaaguuuuguggaccucaaacaguauuguuguguuuuguggcaccucagguacauauggaacaggcucauggccugauggggcggacaucaaucucaugccuauauaa

SEQ ID NO: 46892 - RNA, 1410 nt, Artificial Sequence
  neuraminidase__InfluenzaA__ACA24703
augaauccaaaccaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaucaccauagagaaggaaacaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuugcacaguaguaaugacugaugggagugcuucaggaaacgcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 46893 - RNA, 1413 nt, Artificial Sequence
  neuraminidase__InfluenzaA__ACA33539
augaauccauaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuuuauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46894 - RNA, 1413 nt, Artificial Sequence
  neuraminidase__InfluenzaA__ACA33540
augaauccaaaucaaaaaauaauaaccauuggaucaaucaguauagcaauagggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucgaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuuuauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46895 - RNA, 1413 nt, Artificial Sequence
  neuraminidase__InfluenzaA__ACA33582
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuuuauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccaaugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucagguuacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46896 - RNA, 1413 nt, Artificial Sequence
  neuraminidase__InfluenzaA__ACA33622
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucuuguuucaccauaaugaccgauggcccgaguaauggggccgccucguacaaaaucuucaagaucgaaaagggaaagguuacuaaaucaauagaguuaaaugcacccaauuuuuauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacagacuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaaggccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 46897 - RNA, 1413 nt, Artificial Sequence; identical to SEQ ID NO: 46573
  neuraminidase__InfluenzaA__ACA96522

SEQ ID NO: 46898 - RNA, 1362 nt, Artificial Sequence
  neuraminidase__InfluenzaA__ACC55274
augaauccaaaucagaagauaauaacaauuggcuccgucucucuaaccauugcaacaguauguuuccucaugcagauugccauccuagcaaugacuguaacacugcauuucaggcaaaaugaaugcagcauuucagcgaacagucagguagugccaugugaaccaacuacagagaaagaggucuguucgaaaguaguagacuauagaagcuggucaaagccgcagugucaaauuacaggauuugcuccuuuuuccaaggacaacucaauucgacuuucugcugguggagacauuuggauaacaagagagccuuaugugucgugugacaccagcaaauguuaucaauuugcacuuggacaggggaccacacuggauaacgaacauucaaacggaacaauacaugauagaaucccccaucggacccuuuugaugaaugaacuggguguuccauuucacuugggaaccagacaaguuugcauagcaugguccagcucaaguugccaugauggaaaagcaugguugcacguuugugucacuggggaugauagaaaugcaacugcuaguuucauuuacaaugggaugcuuguugacaguauugguucauggucucaaaauauccucaggacccaggagucagaaugcguuugcaucaaugggucuuguacaguaguaaugacugauggaagugccucagggaaggccgacacuagaauauuauucgucaaagagggaaagauuguucacauuagcccauugucaggaagugcucagcauauagaggaauguuccuguuauccucgauacccaaacgucagaugugucugcagggacaacuggaagggcucuaauaggccuguuauagacauaaacaugacagauuauagcaucgacuccaguuaugugugcucaggacuuguuggggacacaccaaggaaugaggauaguucuaguagcagcaacugcagggauccuaaugaagagaggggaaacccaggagugaaaggaugggccuuugacaguggagaugauguuuggauggguagaacaaucaguagggauucgcggucaggcuaugagacauuuagggucauuggugguuggaccacugccaauuccaaaucacagaccaacagacaagucauaguugauaauaacaauuggucugguuauucugguauuuucucuguugaacacaaaagcuguaucaauagguguuuuuauguggaguuaauaagaggaaggccgaaagaaacuagaguaugguggaccucaaacaguauugucguguuuugcggcacuucaggcacuuauggaacaggcucauggccugauggggcgaacaucaauuucaugccuauauaa

SEQ ID NO: 46899 - RNA, 1413 nt, Artificial Sequence; identical to SEQ ID NO: 46833
  neuraminidase__InfluenzaA__ACC61967

SEQ ID NO: 46900 - RNA, 1413 nt, Artificial Sequence
  neuraminidase__InfluenzaA__ACD11077
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaaggucacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcaguugugauccaguaaauguugauggagcagacggaguaaagggguuuucauacagauaugguaaugguguuuggauaggaaggacuaaaaguaacaacuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauugaccauugacaaguag

SEQ ID NO: 46901 - RNA, 1413 nt, Artificial Sequence
  neuraminidase__InfluenzaA__ACD11078
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguacuaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcaguugugauccaguaaauguugauggagcagacggaguaaagggguuuucauacagauaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauugaccauugacaaguag

SEQ ID NO: 46902 - RNA, 1413 nt, Artificial Sequence
  neuraminidase__InfluenzaA__ACD11079
augaauccaaaucagaaaauaauaaccauuggaucaaucuguauggcaaucggaauaauuagucuaauauugcaaauagggaauauuaucucaauauggguuagccacucaauucaaacuggaagucaaaaccauacaggaauaugcaaccaaagaaucauuaccuaugaaaauagcaccuggguaaaucaaacauauguuaauauuagcaacacuaacguuguugcuggaaaggacacaacuucaaugacauuagccggcaauucaucucuuuguccuauccgugggugggcuauauacagcaaagacaacagcauaagaauugguuccaaaggagauguuuuugucauaagagaaccuuuuauaucauguucucacuuggaaugcagaaccuuuuuucugacccaaggcgcucuauuaaaugacaagcauucaaaugggaccguuaaggacagaagcccuuauagggccuuaaugagcuguccuauaggugaagcuccgucuccauacaauucaagguuugaaucgguugcuuggucagcaagugcaugucacgauggcaugggcuggcuaacaaucggaauuucugguccagaugauggagcaguggcuguaauaaaauacaacggcauaauaacugaaaccauaaaaaguuggaggaagcaaauauuaagaacacaagagucugaaugugucuguguaaacgguucauguuuuaccauaaugaccgauggcccgagugaugggccggccucguacagaaucuucaaaaucgagaaggggaagauuacuaaaucaauagaguuggaugcacccaauucucauuacgaggaauguuccuguuacccagacaccggcacagugaugugugugugcagagacaauuggcaugguucgaaucgaccuugggugucuuuuaaucaaaaccuggauuaucaaauaggauacaucugcagugggguuuucggugacaauccgcgucccaaagauggaaaaggcaguugugauccaguaaauguugauggagcagacggaguaaagggguuuucauacagauaugguaaugguguuuggauaggaaggacuaaaaguaacagcuccagaaagggauuugagaugauuugggauccuaauggauggacagauaccgauaguaauuucuuagugaaacaggauguaguggcaaugacugauuggucaggguacagcggaaguuucguucaacauccugagcuaacaggauuggacuguaugaggccuugcuucuggguugaauuaaucagaggacgacccagagaaaaaacaacaaucuggacuagugggagcagcauuucuuuuuguggcgugaauagugauacuguaaauuggucuuggccagacggugccgaguugccauugaccauugacaaguag

SEQ ID NO: 46903 - RNA, 1413 nt, Artificial Sequence; identical to SEQ ID NO: 46832
  neuraminidase__InfluenzaA__ACD56116

SEQ ID NO: 46904 - RNA, 1413 nt, Artificial Sequence
  neuraminidase__InfluenzaA__ACD56127
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguuuggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucaguuaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucacuauugacaaguag

SEQ ID NO: 46905 - RNA, 1410 nt, Artificial Sequence; identical to SEQ ID NO: 46553
  neuraminidase__InfluenzaA__ACD56261

SEQ ID NO: 46906 - RNA, 1410 nt, Artificial Sequence
  neuraminidase__InfluenzaA__ACD56272
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugagcuagguguuccauuucaucuggggaccaagcaagugugcauagcaugguccagcucaaguugucacgauggaaaagcauggcugcauguuugugugacgggggaugacaaaaaugcaacugcuagcuucauuuacaaugggaggcuuguagauaguauuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccaucguagauauaaacauaaaggacuauagcauuguuuccagauauguuugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaccgaaguuuuguggaccucaaacaguauuguuguguuuuguggcaccucagguacauauggaacaggcucauggccugauggggcggacaucaaucucaugccuauauaa

SEQ ID NO: 46907 - RNA, 1413 nt, Artificial Sequence
  neuraminidase__InfluenzaA__ACD56283
augaauccaaaucaaaaaauaauaaccauuggaucaaucaguauggcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugauaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 46908 - RNA, 1410 nt, Artificial Sequence
  neuraminidase__InfluenzaA__ACD56305
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaauggaacuugcacaguaguaaugacugauggaagugcuucaggaagagccgauacuaggauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuaguuggcgacacacccagaaacgacgacagaucuagcaauagcaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 46909 - RNA, 1410 nt, Artificial Sequence
  neuraminidase__InfluenzaA__ACD56316
augaauccaaaucaaaagauaauaacaauuggcucugucucucucaccauugcaacaguaugcuuccucaugcagauugccauccugguaacuacugugacauugcauuuuaagcaacaugagugcgacucccccgcgagcaaccaaguaaugccgugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuauggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggcgacacacccagaaacgacgacagaucuagcaauaguaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagaugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 46910 - RNA, 1410 nt, Artificial Sequence
  neuraminidase__InfluenzaA__ACD56327
augaauccaaaucaaaagauaauaacaauugguucugucucucucacuauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaaucacaggauuugcaccuuuuucuaaggacaauucaauccggcuuucugcugguggggacauuugggugacgagagaaccuuaugugucaugcgauccuagcaagugucaucaauuugcacucgggcaggggaccacacuagaaaacaaacauucaaauggcacaaaacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuauggcgggaggcuuguggacaguauuguuucauggucucaaaauauccucaggacccaggagucggaaugcguuuguaucaaugggacuugcacagugguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaagggcucuaauaggcccguuauagacauaaauauggaagauuauagcauugauuccagcuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguugacagcaauaauuggucugguuacucugguauuuucucuguugagggcaaaagcugcaucaauaggugcuuuuauguggaguugauaaggggaaggccacaggagacuagaguaugguggacaucaaacaguauuguuguguuuuguggcacuucagguacuuauggaacaggcucauggccugauggggcgaacaucaauuucaugccuauauaa

SEQ ID NO: 46911 - RNA, 1410 nt, Artificial Sequence
  neuraminidase__InfluenzaA__ACD85190
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagaucugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccaucauagacauaaauauggaagauuauagcauugauuccaguuaugugugcucagggcuuguuggcgacacacccagaaacgacgacagaucuagcaauagcaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 46912 - RNA, 1410 nt, Artificial Sequence
  neuraminidase__InfluenzaA__ACD85201
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaggagauaugccccaaaguaguggaauacagaaauuggucaaagccgcaaugucaaauuacaggauuugcaccuuuuucuaaggacaacucaauccggcuuucugcugguggggacauuugggugacgagagaaccuuaugugucaugcgauccuggcaaguguuaucaauuugcacucgggcaagggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauuaguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucuggaagugcucagcauguagaggaguguuccuguuauccucgauauccugacgucagauguaucugcagagacaacuggaaagguucuaauaggcccgucauagacauaaauauggaagauuauagcauugauuccaguuaugugugcucagggcuuguuggcgacacacccagaaacgacgacagaucuagcaauagcaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 46913 - RNA, 1410 nt, Artificial Sequence
  neuraminidase__InfluenzaA__ACD85212
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaaaagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46914 - RNA, 1410 nt, Artificial Sequence
  neuraminidase__InfluenzaA__ACD85223
augaauccaaaucaaaagauaauaacaauuggcucugucucucucaccauugcaacagcaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagaucugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacucuucauugaagaggggaaaauuguccauauuagcccauugucaggaagugcucagcauguagaggaguguuccuguuauccucgauauccugacgucagauguaucugcagagacaacuggaaaggcucuaauaggcccaucauagacauaaauauggaagauuauagcauugauuccaguuaugugugcucagggcuuguuggcgacacacccagaaacgacgacagaucuagcaauagcaauugcaggaauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 46915 - RNA, 1410 nt, Artificial Sequence
  neuraminidase__InfluenzaA__ACD85234
augaauccaaaucaaaagauaauaacaauuggcucugucucucucaccauugcaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugauggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauuuacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46916 - RNA, 1410 nt, Artificial Sequence
  neuraminidase__InfluenzaA__ACD85245
augaauccaaaucaaaagauaauaacaauuggcucugucucucucaucauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccagaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggagaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggcuuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgaugaucggucagguuacucugguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46917 - RNA, 1410 nt, Artificial Sequence
  neuraminidase__InfluenzaA__ACD85454
augaauccaaaucaaaagauaauaacgauuggcucuguuucucucaccauuuccacaauaggcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46918 - RNA, 1410 nt, Artificial Sequence
  neuraminidase__InfluenzaA__ACD85465
augaauccaaaucaaaagauaauaacgauuggcucuguuucucucaccauuuccacaauaggcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46919 - RNA, 1410 nt, Artificial Sequence
  neuraminidase__InfluenzaA__ACD85487
augaauccaaaucaaaagauaauaacgauuggcucuguuucucucaucauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46920 - RNA, 1410 nt, Artificial Sequence
  neuraminidase__InfluenzaA__ACD85498
augaauccaaaucaaaagauaauaacgauuggcucuguuucucucaucaucuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46921 - RNA, 1410 nt, Artificial Sequence
  neuraminidase__InfluenzaA__ACD85509
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguagucguggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46922 - RNA, 1410 nt, Artificial Sequence
  neuraminidase__InfluenzaA__ACD85520
augaauccaaaucaaaagauaauaacgauuggcucuguuucucucaucauuuccacaauaggcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46923 - RNA, 1410 nt, Artificial Sequence
  neuraminidase__InfluenzaA__ACD85553
augaauccaaaucaaaagauaauaacgauuggcucuguuucucucaccauuuccacaauaggcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46924 - RNA, 1410 nt, Artificial Sequence
  neuraminidase__InfluenzaA__ACD85564
augaauccaaaucaaaagauaauaacgauuggcucuguuucucucaucauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagacagcgcaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46925 - RNA, 1410 nt, Artificial Sequence
  neuraminidase__InfluenzaA__ACD85575
augaauccaaaucaaaagauaauaacgauuggcucuguuucucucaucauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46926 - RNA, 1410 nt, Artificial Sequence
  neuraminidase__InfluenzaA__ACD85586
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgaugggaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucguggagugaaaggcugggccuuugaugauggaaaugacguguggaugggaagaacgaucagcgagaagucacgcuuaggguaugaaaccuucaaagucauugaaggcugguccaacccuaaguccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46927 - RNA, 1410 nt, Artificial Sequence
  neuraminidase__InfluenzaA__ACD93582
augaauccaaaucaaaagauaauaacgauuggcucuguuucucucaccauuuccacaauaugcuucuucaugcaaauugccaucuuggcaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguagaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46928 - RNA, 1410 nt, Artificial Sequence
  neuraminidase__InfluenzaA__ACF09403
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuucucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46929 - RNA, 1410 nt, Artificial Sequence
  neuraminidase__InfluenzaA__ACF22151
augaauccaaaucaaaagauaauaacgauuggcucuguuucccucaccauuuccacaauaugcuucuucaugcaaauugccauccugauaacuacuguaacauugcauuucaagcaauaugaauucaacucucccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaggugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauacccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggccuuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 46930 - RNA, 1410 nt, Artificial Sequence; identical to SEQ ID NO: 44599
  neuraminidase__InfluenzaA__ACF22246

SEQ ID NO: 46931 - RNA, 1410 nt, Artificial Sequence; identical to SEQ ID NO: 44599
  neuraminidase__InfluenzaA__ACF22257

SEQ ID NO: 46932 - RNA, 1410 nt, Artificial Sequence; identical to SEQ ID NO: 44599
  neuraminidase__InfluenzaA__ACF22279

SEQ ID NO: 46933 - RNA, 1410 nt, Artificial Sequence; identical to SEQ ID NO: 44599
  neuraminidase__InfluenzaA__ACF22290

SEQ ID NO: 46934 - RNA, 1410 nt, Artificial Sequence; identical to SEQ ID NO: 44599
  neuraminidase__InfluenzaA__ACF22301

SEQ ID NO: 46935 - RNA, 1410 nt, Artificial Sequence; identical to SEQ ID NO: 44599
  neuraminidase__InfluenzaA__ACF22312

SEQ ID NO: 46936 - RNA, 1410 nt, Artificial Sequence
  neuraminidase__InfluenzaA__ACF22323
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccguaugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugccggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46937 - RNA, 1410 nt, Artificial Sequence
  neuraminidase__InfluenzaA__ACF22334
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugccggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46938 - RNA, 1410 nt, Artificial Sequence; identical to SEQ ID NO: 44599
  neuraminidase__InfluenzaA__ACF22367

SEQ ID NO: 46939 - RNA, 1410 nt, Artificial Sequence
  neuraminidase__InfluenzaA__ACF22378
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaagaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46940 - RNA, 1410 nt, Artificial Sequence
  neuraminidase__InfluenzaA__ACF22389
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuuguaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46941 - RNA, 1410 nt, Artificial Sequence
  neuraminidase__InfluenzaA__ACF22400
augaauccaaaucaaaagauaauaacaauuggcucugucucucucacuauugcaacaguaugcuuccucaugcagauugccauccugguaacuacuguaacauugcauuuuaaacaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuauggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagguauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46942 - RNA, 1410 nt, Artificial Sequence; identical to SEQ ID NO: 46582
  neuraminidase__InfluenzaA__ACF22411

SEQ ID NO: 46943 - RNA, 1413 nt, Artificial Sequence
  neuraminidase__InfluenzaA__ACF33772
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggccggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuuuauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauauugcaaacuggucuuggccagacggugcugaguugccguucaccauugacaaguag

SEQ ID NO: 46944 - RNA, 1410 nt, Artificial Sequence
  neuraminidase__InfluenzaA__ACF33778
augaauccaaaucaaaagauaauaacgauuggcucuguuucucucaccauuuccacaauaugcuucuucaugcaaauugccaucuugauaacuacuguaacauugcauuucaagcaauaugaauucagcucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcucuuggacagggaacaacacuaaacaacgugcauucaaaugacacaguacaugauaggaccccuuaucggacccuauugaugaaugagcuagguauuccauuucaucuggggaccaagcaagugugcauagcaugguccagcucaaguugucacgauggaaaagcauggcugcauguuuguguaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagaaugucgaggagugcuccugcuauccucgauauccuggugucagaugugucugcagagacaauuggaaaggcuccaauaggcccaucguagauauaaacauaaaggauuauagcauuguuuccagauaugugugcucaggacuuguuggagacacacccagaaaaaacgacagcuccagcaguagccauugcuugaauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaacaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggacaucaaucucaugccuauauaa

SEQ ID NO: 46945 - RNA, 1410 nt, Artificial Sequence
  neuraminidase__InfluenzaA__ACF33785
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacauguuaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagauauccucaggacccaggagucagaaugcguuuguaucaauggaacuugcacaguaguaaugacugaugggagugcuucaggaaaagcugauacuaaaauacuauucauugaggaggggaaaaucguucauacuagcacauugucaggaagugcucagcauguugaggagugcuccugcuauccucgauauccuggugucagaugugucugcagagacaacuggaaaggcuccaauaggcccauuguagauauaaacauaaaggauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 46946 - RNA, 1413 nt, Artificial Sequence
  neuraminidase__InfluenzaA__ACF33787
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggccggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccggguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuaaagaaaauacaacaaucuggacuagugggagcagcauuucuuuuuguggcguuaauagugguauugcaaacuggucuuggccagacggugcugaguugccguucaccauugacaaguag

SEQ ID NO: 46947 - RNA, 1410 nt, Artificial Sequence
  neuraminidase__InfluenzaA__ACF33798
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacaucacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46948 - RNA, 1410 nt, Artificial Sequence; identical to SEQ ID NO: 46561
  neuraminidase__InfluenzaA__ACF41672

SEQ ID NO: 46949 - RNA, 1413 nt, Artificial Sequence; identical to SEQ ID NO: 46535
  neuraminidase__InfluenzaA__ACF41683

SEQ ID NO: 46950 - RNA, 1410 nt, Artificial Sequence
  neuraminidase__InfluenzaA__ACF41749
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagggauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauucgcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46951 - RNA, 1410 nt, Artificial Sequence
  neuraminidase__InfluenzaA__ACF41760
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucguggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46952 - RNA, 1410 nt, Artificial Sequence
  neuraminidase__InfluenzaA__ACF41771
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaauaacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46953 - RNA, 1410 nt, Artificial Sequence; identical to SEQ ID NO: 44599
  neuraminidase__InfluenzaA__ACF41793

SEQ ID NO: 46954 - RNA, 1410 nt, Artificial Sequence; identical to SEQ ID NO: 44599
  neuraminidase__InfluenzaA__ACF41804

SEQ ID NO: 46955 - RNA, 1410 nt, Artificial Sequence; identical to SEQ ID NO: 44599
  neuraminidase__InfluenzaA__ACF41826

SEQ ID NO: 46956 - RNA, 1365 nt, Artificial Sequence; identical to SEQ ID NO: 46223
  neuraminidase__InfluenzaA__ACF41837

SEQ ID NO: 46957 - RNA, 1413 nt, Artificial Sequence
  neuraminidase__InfluenzaA__ACF41881
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaguaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccguucaccauugacaaguag

SEQ ID NO: 46958 - RNA, 1410 nt, Artificial Sequence
  neuraminidase__InfluenzaA__ACF41892
augaauccaaaucaaaagauaauaacgauuggcucuguuucccucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaauuguucauacuagcacauuaucaggaagugcucagcaugucgaggagugcuccuguuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccaaacaaugaggaagguggucauggagugaaaggcugggcauuugaugauggaaaugacguguggaugggaagaacgaucagcgagaaguuacgcucaggauaugaaaccuucaaagucauugaaggcugguccaacccuaacuccaaauugcagauaaauaggcaagucauaguugacagagguaacagguccgguuauucugguauuuucucuguugaaggcaaaagcugcaucaaucggugcuuuuauguggaguugauaaggggaagaaaacaggaaacugaagucuuguggaccucaaacaguauuguuguguuuuguggcaccucagguacauauggaacaggcucauggccugauggggcggacaucaaucucaugccuauauaa

SEQ ID NO: 46959 - RNA, 1410 nt, Artificial Sequence
  neuraminidase__InfluenzaA__ACF41903
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46960 - RNA, 1410 nt, Artificial Sequence
  neuraminidase__InfluenzaA__ACF41914
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauaucuuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46961 - RNA, 1413 nt, Artificial Sequence
  neuraminidase__InfluenzaA__ACF41925
augaauccaaaucaaaaaauaauaaccauuggaucaaucaguauggcaaucggaauaauuagucuaauauugcaaauaggaaauauuauuucaauaugggcuagccacucaauccaaacuggaagucaaaaccacacuggaauaugcaaccaaagaaucauuacauaugaaaauagcaccugggugaaucaaacauauguuaauauuaacaacacuaauguuguugcuggaaaggacaaaacuucagugacauuggccggcaauucaucucuuugcccuauccgugggugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcaugggcuggcuaacaaucggaauuucugguccagauaauggagcaguggcuguacuaaaauacaacggcauaauaacugaaaccauaaaaaguuggaagaagcgaauauuaagaacacaagagucugaaugugucugugugaacgguucauguuuuaccauaaugaccgauggcccgaguaauggggccgccucguacagaaucuucaaaaucgagaaggggaagguuacuaaaucaauagaguuggaugcacccaauuaucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucugugaaacaggaugucguggcaaugacugauuggucaggguacagcggaaguuucguucaacauccugagcuaacaggauuggacuguaugagaccuugcuucuggguugaauuaaucagagggcgaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 46962 - RNA, 1413 nt, Artificial Sequence; identical to SEQ ID NO: 46961
  neuraminidase__InfluenzaA__ACF41936

SEQ ID NO: 46963 - RNA, 1410 nt, Artificial Sequence
  neuraminidase__InfluenzaA__ACF54392
augaauccaaaucaaaagauaauaacaauuggcucuguaucucucaccaccgcaacagcaugcuuccucacgcagaucgccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauucuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagauuuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacuccgguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 46964 - RNA, 1410 nt, Artificial Sequence; identical to SEQ ID NO: 44599
  neuraminidase__InfluenzaA__ACF54403

SEQ ID NO: 46965 - RNA, 1410 nt, Artificial Sequence; identical to SEQ ID NO: 44599
  neuraminidase__InfluenzaA__ACF54414

SEQ ID NO: 46966 - RNA, 1410 nt, Artificial Sequence; identical to SEQ ID NO: 44599
  neuraminidase__InfluenzaA__ACF54425

SEQ ID NO: 46967 - RNA, 1410 nt, Artificial Sequence
  neuraminidase__InfluenzaA__ACF54436
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucaacauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46968 - RNA, 1410 nt, Artificial Sequence
  neuraminidase__InfluenzaA__ACF54447
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaagcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46969 - RNA, 1410 nt, Artificial Sequence
  neuraminidase__InfluenzaA__ACF54469
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaacuaggcaaguguguauggcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 46970 - RNA, 1410 nt, Artificial Sequence
  neuraminidase__InfluenzaA__ACF54480
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46971 - RNA, 1410 nt, Artificial Sequence
  neuraminidase__InfluenzaA__ACF54502
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuucauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46972 - RNA, 1410 nt, Artificial Sequence; identical to SEQ ID NO: 46971
  neuraminidase__InfluenzaA__ACF54513

SEQ ID NO: 46973 - RNA, 1410 nt, Artificial Sequence
  neuraminidase__InfluenzaA__ACF54524
augaauccaaaucaaaagauaauaacaauuggcucugucucucucaccauugcaacaguaugcuucuucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuucauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 46974 - RNA, 1410 nt, Artificial Sequence
  neuraminidase__InfluenzaA__ACF54535
augaauccaaaucaaaagauaauaacgauuggcucuguuucucucaucaucuccacaauaugcuucuucaugcaaacugccaucuugauaacuacuguaacauugcauuucaagcaauaugaauucaacucccccccaaacaaccaagugaugcugugugaaccaacaauaauagaaagaaacauaacaaagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46975 - RNA, 1410 nt, Artificial Sequence
  neuraminidase__InfluenzaA__ACF54557
augaauccaaaucaaaagauaauaacgauuggcucuguuucucucacuauugccacaauaugcuuccuuaugcaaauagccauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggauaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaaguguguauagcaugguccagcucaaguugucacgauggaaaagcauggcugcauguuuguguaacugggcaugaugaaaaugcaacugcuagcuucauuuacgaugggagacuuguagauaguauugguucaugguccaaaaaaauccucaggacccaggagucggaaugcguuuguaucaauggaacuuguacaguaguaaugacugaugggagugcuucaggaagagcugauacuaaaauacuuuucauugaggaggggaaaaucguucauacuagcaaauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugccuggauccuaacaaugaagaagggggucauggagugaaaggcugggccuuugaugauggaaaugacguguggaugggaagaacgaucagcgagaagucacgcucagguuaugaaaccuucaaggucauugaaggcugguccaaaccuaacuccaaauugcagauaaauaggcaagucauaguugaaagagguaauauguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 46976 - RNA, 1410 nt, Artificial Sequence; identical to SEQ ID NO: 46958
  neuraminidase__InfluenzaA__ACF54568

SEQ ID NO: 46977 - RNA, 1410 nt, Artificial Sequence
  neuraminidase__InfluenzaA__ACF54579
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuugggcagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaauaacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 46978 - RNA, 1362 nt, Artificial Sequence
  neuraminidase__InfluenzaA__ACF54601
augaauccaaaccagaaaauaauaaccauugggucaaucuguaugguagucggaauaauuagccuaauauugcaaauaggaaauauaaucucaauauggauuagccauucaauucaaaccggaaaucaaaaccauacuggaauaugcaaccaaggcagcauuaccuauaaaguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaagggggaccuuuaaggacagaagcccuuauagggccuuaaugagcugcccugucggugaagcuccguccccguacaauucaagguuugaaucgguugcuuggucagcaagugcaugucaugauggaaugggcuggcuaacaaucggaauuucugguccagaugauggagcaguggcuguauuaaaauacaacggcauaauaacugaaaccauaaaaaguuggaggaagaauauauugagaacacaagagucugaauguaccuguguaaaugguucauguuuuaccauaaugaccgauggcccaagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuauaaaauaggauacaucugcagugggguuuucggugacaacccgcgucccaaagauggaacaggcagcuguggcccagugucugcugauggagcaaacggaguaaagggauuuucauauaaguaugguaaugguguuuggauaggaaggacuaaaagugacaguuccagacauggguuugagaugauuugggauccuaauggauggacagagacugauaguagguucucuaugagacaagauguuguggcaaugacugaucggucaggguacagcggaaguuucguucaacauccugagcuaacagggcuagacuguaugaggccuugcuucuggguugaauuaaucagggggcuaccugaggagaacgcaaucuggacuagugggagcaucauuucuuuuuguggugugaauagugauacuguagauuggucuuggccagacggugcugaguugccguucaccauugacaaguag

SEQ ID NO: 46979 - RNA, 1350 nt, Artificial Sequence
  neuraminidase__InfluenzaA__ACG50700
augaauccaaaucagaagauaauaacuaucggaucaaucuguaugguaauuggaauaguuagcuuaauguuacaaauugggaacaugaucucaauaugggucagucauucaauucagacagggaaucaacaccaagcugagccaaucagcaauacuaauuuucuuaccgagaaagcuguggcuucaguaacauuagcgggcaauucaccucuuugccccauuagugguugggccguacacaguaaggacaauaguauaaggaucgguucuaagggggauguguuuguuauaagagaaccguucaucucgugcucccacuuggaaugcagaacuuucuuuuugacucagggagccuugcugaaugacaagcacuccaaugggacuguuaaagacaggagcccucacagaacacuaaugaguuguccugugggugaggcucccuccccauauaacucaagguuugagucuguugcuuggucagcaagugccugccaugauggcaccaguugguugacaauuggaauuucuggcccagacaauggggcuguggcuguauugaaguacaauggcauaauaacagacacuaucaagaguuggaggaacaacauacugagaacucaagagucugaaugugcauguguaaauggcucuugcuuuacuguaaugacugauggaccaaguaaugggcaggcaucauauaaaaucuucaaaauggaaaaagggaaggugguuaaaucagucgaauuggaugcuccuaauuaucacuaugaggagugcuccuguuauccugaugccagcgaagucacaugugugugcagagauaauuggcauggcucaaauaggccauggguaucuuucaaucaaaauuuggaguaucaaauaggguauauaugcaguggaguuuucggagacaauccacgccccaaugauggaacagguaguugugguccgguguccacuaacggggcauaugggguaaaaggguuuucauuuaaauacggcaaugguguuuggaucgggagaaccaaaagcacuaauuccaggaguggcuuugaaaugauuugggauucaaauggguggacuggaacggacaguagcuuuucggugaaacaagauaucguagcaauaacugauuggucaggauauagcgggaguuuuguccagcauccagaacugacaggauuagauugcauaagaccuuguuucuggguugaguuaaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 46980 - RNA, 1410 nt, Artificial Sequence; identical to SEQ ID NO: 46561
  neuraminidase__InfluenzaA__ACG70145

SEQ ID NO: 46981 - RNA, 1410 nt, Artificial Sequence; identical to SEQ ID NO: 46553
  neuraminidase__InfluenzaA__ACG70156

SEQ ID NO: 46982 - RNA, 1410 nt, Artificial Sequence
  neuraminidase__InfluenzaA__ACG80407
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcaaaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacagcacgugguaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46983 - RNA, 1410 nt, Artificial Sequence
  neuraminidase__InfluenzaA__ACG80411
auggauucaaauucaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacagcaggugguaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacgaugggaggcuuguagaugguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46984 - RNA, 1407 nt, Artificial Sequence
  neuraminidase__InfluenzaA__ACG80421
augaauccaauucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucugacacagcacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46985 - RNA, 1407 nt, Artificial Sequence
  neuraminidase__InfluenzaA__ACG80427
auggaucccaauucaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucugacacagcacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46986 - RNA, 1410 nt, Artificial Sequence
  neuraminidase__InfluenzaA__ACG80437
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuaacuucauuuacaaugggaggcuuguagauaguauuguuucaugguccaaagaaaucuuuaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggauggggagaacgaucagcgagaagucacgcucaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46987 - RNA, 1407 nt, Artificial Sequence
  neuraminidase__InfluenzaA__ACG80446
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucugacacagcacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46988 - RNA, 1410 nt, Artificial Sequence
  neuraminidase__InfluenzaA__ACG80455
augaauccuaaucaaaagauaauaacgauuggcucuguuucuuucaucaucuccucaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacagcacgugguaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacgaugggaggcuuguagauaguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46989 - RNA, 1407 nt, Artificial Sequence; identical to SEQ ID NO: 46987
  neuraminidase__InfluenzaA__ACG80464

SEQ ID NO: 46990 - RNA, 1410 nt, Artificial Sequence
  neuraminidase__InfluenzaA__ACG80473
auggauccaauucaaaagauaauaacgauuggcucuguuucucucaccauuuccacaauaugcuucuucaugcaaauugccaucuugauaacuacuguaacauugcauuucaagcaauaugaauucaacucccccccaaacaaccaaaugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacagcacgugguaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcuacugcuagcuucauuuacgaugggaggcuuguagauaguguuguuucaugguccaaagaaauccucaggacccaggagucagaaugcguuuguaucaauggaacuuguacaguagugaugacugaugggagugcuucaggagaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaggguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46991 - RNA, 1410 nt, Artificial Sequence; identical to SEQ ID NO: 45232
  neuraminidase__InfluenzaA__ACH69559

SEQ ID NO: 46992 - RNA, 1410 nt, Artificial Sequence
  neuraminidase__InfluenzaA__ACH69570
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaauaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 46993 - RNA, 1410 nt, Artificial Sequence
  neuraminidase__InfluenzaA__ACH69581
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagggaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacuucagguacauauggaacaggcucauggccugauggggcggacaucaaucucaugccuauauaa

SEQ ID NO: 46994 - RNA, 1410 nt, Artificial Sequence
  neuraminidase__InfluenzaA__ACH69592
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucagugcuuuuauguggaguugauaaggggaaggaaacaggaaacugaagucuuguggaccucaaacaguauuguuguguuuuguggcaccucagguacauauggaacaggcucauggccugauggggcggaccucaaucucaugccuauauaa

SEQ ID NO: 46995 - RNA, 1410 nt, Artificial Sequence
  neuraminidase__InfluenzaA__ACH69603
augaauccaaaucaaaagauaauaacgauuggcucuguuucucucaccauugccacaauaugcuuccuuaugcaaauugucauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagaggcaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggaccucaaucucaugccuauauaa

SEQ ID NO: 46996 - RNA, 1410 nt, Artificial Sequence
  neuraminidase__InfluenzaA__ACH69614
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggaccucaaucucaugccuauauaa

SEQ ID NO: 46997 - RNA, 1413 nt, Artificial Sequence
  neuraminidase__InfluenzaA__ACI22525
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 46998 - RNA, 1413 nt, Artificial Sequence; identical to SEQ ID NO: 46997
  neuraminidase__InfluenzaA__ACI22526

SEQ ID NO: 46999 - RNA, 1413 nt, Artificial Sequence; identical to SEQ ID NO: 46997
  neuraminidase__InfluenzaA__ACI22527

SEQ ID NO: 47000 - RNA, 1413 nt, Artificial Sequence; identical to SEQ ID NO: 46997
  neuraminidase__InfluenzaA__ACI22528

SEQ ID NO: 47001 - RNA, 1413 nt, Artificial Sequence; identical to SEQ ID NO: 46997
  neuraminidase__InfluenzaA__ACI22529

SEQ ID NO: 47002 - RNA, 1413 nt, Artificial Sequence; identical to SEQ ID NO: 46997
  neuraminidase__InfluenzaA__ACI22530

SEQ ID NO: 47003 - RNA, 1413 nt, Artificial Sequence
  neuraminidase__InfluenzaA__ACI22532
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 47004 - RNA, 1413 nt, Artificial Sequence; identical to SEQ ID NO: 47003
  neuraminidase__InfluenzaA__ACI22533

SEQ ID NO: 47005 - RNA, 1413 nt, Artificial Sequence; identical to SEQ ID NO: 46997
  neuraminidase__InfluenzaA__ACI22534

SEQ ID NO: 47006 - RNA, 1410 nt, Artificial Sequence
  neuraminidase__InfluenzaA__ACI25727
augaauccaaaucaaaagauaauaacaauuggcucugucucucucaccauugcaacaguaugcuuccucaugcagauugccauccugguaacuacuguaacauugcauuuuaagcaacaugagugcaacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugauaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauuaaagagggaaaaauuguccauauuagcccauugucaggaagugcucagcauguagaggaguguuccuguuauccucgauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacuccgguauuuucucuguugagggcaaaagcugcaucaauaggugcuuuuauguggaguugauaaggggaaggaaacaggagacuagaguaugguggaccucaaacaguauuguuguguuuuguggcacuucagguaccuauggaacaggcucauggccugauggggcgaacaucaauuucaugccuauauaa

SEQ ID NO: 47007 - RNA, 1410 nt, Artificial Sequence
  neuraminidase__InfluenzaA__ACI25749
augaauccaaaucaaaagauaauaacaauuggcucugucucucucaccauugcaacaguaugcuuccucaugcagauugccauccugguaacuacuguaacauugcauuuuaagcaauaugagugcgacucccccgcaagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugcauauauaa

SEQ ID NO: 47008 - RNA, 1410 nt, Artificial Sequence
  neuraminidase__InfluenzaA__ACI25760
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugcauauauaa

SEQ ID NO: 47009 - RNA, 1410 nt, Artificial Sequence; identical to SEQ ID NO: 47008
  neuraminidase__InfluenzaA__ACI25771

SEQ ID NO: 47010 - RNA, 1410 nt, Artificial Sequence; identical to SEQ ID NO: 44599
  neuraminidase__InfluenzaA__ACI25782

SEQ ID NO: 47011 - RNA, 1410 nt, Artificial Sequence
  neuraminidase__InfluenzaA__ACI25793
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucuguugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 47012 - RNA, 1410 nt, Artificial Sequence
  neuraminidase__InfluenzaA__ACI25804
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucucaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgaucaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 47013 - RNA, 1410 nt, Artificial Sequence
  neuraminidase__InfluenzaA__ACI26277
augaauccaaaucaaaagauaauaacaauuggcucugucucucucaccauugcaacaguaugcuuccucaugcagauugccauccuggcaacuacugugacauugcauuuuaaacaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuucauuucauuuaggaaccaaacaaguguguguagcaugguccagcucaaguugucacgauggaaaagcaugguugcauguuugugucacuggggaugauagaaaugcgacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucaacaaagauucacgcucagguuaugaaacuuucaaagucauuggugguugguccacaccuaauuccaaaucgcaggucaauagacaggucauaguugacaacaauaauuggucggguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 47014 - RNA, 1410 nt, Artificial Sequence; identical to SEQ ID NO: 46959
  neuraminidase__InfluenzaA__ACI26299

SEQ ID NO: 47015 - RNA, 1410 nt, Artificial Sequence
  neuraminidase__InfluenzaA__ACI26321
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcacuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucgcgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47016 - RNA, 1410 nt, Artificial Sequence
  neuraminidase__InfluenzaA__ACI26354
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaagaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47017 - RNA, 1410 nt, Artificial Sequence
  neuraminidase__InfluenzaA__ACI26365
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugacaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguguucauggagugaaaggcugggccuuugaugauggaaaugacguguggaugggaagaacgaucagcgagaagucacgcuuaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47018 - RNA, 1410 nt, Artificial Sequence
  neuraminidase__InfluenzaA__ACI26376
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47019 - RNA, 1410 nt, Artificial Sequence
  neuraminidase__InfluenzaA__ACI26387
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccaugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagauaacuggaaaggcucuaauaggcccgucauagacauaaauauggaagauuauagcauugauuccaguuaugugugcucagggcuuguuggcgacacacccagaaacgacgauagaucuagcaauagcaauugcagggauccuaacaaugagagagggaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagcugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 47020 - RNA, 1410 nt, Artificial Sequence
  neuraminidase__InfluenzaA__ACI26420
augaauccaaaucaaaagauaauaacgauuggcucuguuucucucaucaucuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacaguuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47021 - RNA, 1410 nt, Artificial Sequence; identical to SEQ ID NO: 46959
  neuraminidase__InfluenzaA__ACI26431

SEQ ID NO: 47022 - RNA, 1413 nt, Artificial Sequence
  neuraminidase__InfluenzaA__ACI26442
augaacccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuauugauggagcagacggaguaaaaggguuuucauacaaauaugguaaugguguuuggauaggaaggaccaaaaguaacagacuuagaaagggguuugaaaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47023 - RNA, 1413 nt, Artificial Sequence; identical to SEQ ID NO: 47022
  neuraminidase__InfluenzaA__ACI26453

SEQ ID NO: 47024 - RNA, 1410 nt, Artificial Sequence
  neuraminidase__InfluenzaA__ACI26464
augaauccaaaucaaaagauaauaacgauuggcucuguuucucucaccauuuccacaauaugcuucuucaugcaaauugccaucuugauagcuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcacuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucgcgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47025 - RNA, 1410 nt, Artificial Sequence; identical to SEQ ID NO: 47015
  neuraminidase__InfluenzaA__ACI26475

SEQ ID NO: 47026 - RNA, 1410 nt, Artificial Sequence; identical to SEQ ID NO: 47016
  neuraminidase__InfluenzaA__ACI26486

SEQ ID NO: 47027 - RNA, 1410 nt, Artificial Sequence; identical to SEQ ID NO: 47018
  neuraminidase__InfluenzaA__ACI26497

SEQ ID NO: 47028 - RNA, 1410 nt, Artificial Sequence; identical to SEQ ID NO: 47018
  neuraminidase__InfluenzaA__ACI26508

SEQ ID NO: 47029 - RNA, 1410 nt, Artificial Sequence
  neuraminidase__InfluenzaA__ACI26519
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccugguguaagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 47030 - RNA, 1410 nt, Artificial Sequence; identical to SEQ ID NO: 47018
  neuraminidase__InfluenzaA__ACI26530

SEQ ID NO: 47031 - RNA, 1410 nt, Artificial Sequence; identical to SEQ ID NO: 47018
  neuraminidase__InfluenzaA__ACI26541

SEQ ID NO: 47032 - RNA, 1410 nt, Artificial Sequence
  neuraminidase__InfluenzaA__ACI26552
augaauccaaaucaaaagauaauaacaauuggcucuguuucucucaccauugccacaaugugcuuccuuaugcaaauugccauccugguaacuacuguaacauugcauuucaagcaauaugagugcagcucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuugggcagggaaccacacuaaacaacaggcauucaaaugacacaguacaugauaggaccccuuaucgaacccuccugaugaaugaguuggguguuccauuucauuugggaaccaagcaagugugcauagcaugguccagcucaaguugucacgauggaaaagcauggcugcauguuugugucacugggcaugauaaaaaugcaacugcaagcuucauuuacgaugggaggcuuguagacaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaacaaugagaaagggagucauggagugaaaggcugggccuuugacgauggaaaugacguguggaugggaagaacaaucagcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaagggaacaggaaacuagagucugguggaccucaaacaguauuguuguguuuuguggcaccucagguacauauggaacaggcucauggccugauggggcagacaucaaucucaugccuauauaa

SEQ ID NO: 47033 - RNA, 1410 nt, Artificial Sequence
  neuraminidase__InfluenzaA__ACI26574
augaauccaaaucaaaagauaauaacaauuggcucuguuucucucacccuugccacaauaugcuuccuuaugcaaauugccauccugguaacuacuguaacauugcauuucaagcaauaugagugcagcucccccccaaacaaccaaguaaugccgugcgaaccaacaauaauagaaagaaacauaacagagauaguguauuugacuaacaucaccauagagaaagagauaugccccaaacuaguagaauacagaaauuggucaaagccgcaauguaaaauuacaggauuugcaccuuuuucuaaggacaauucaauucggcuuuccgcugguggagacauuuggguaacaagagaaccuuaugugucaugcgauccuagcaaguguuaucaauuugcacuugggcagggaaccacacuaaacaacaggcauucaaaugacacaguacaugauaggaccccuuaucgaacucucuugaugaacgaguuggguguuccauuucauuugggaaccaggcaagugugcauggcaugguccagcucaagcugccacgauggaaaagcauggcugcauguuugugucacugggcaugaugaaaaugcaacugcuagcuucauuuacgaugggaggcuuguagacaguauugguucaugguccaaaaauauacucaggacccaggagucggaaugcguuuguaucaaugggacuuguacaguaguaaugacugauggaagugcuucagaaagagcugauacuaaaauacuauucauugaagaggggaaaaucguucauauuagcccauugucaggaagugcucagcauguggaggagugcuccuguuauccucgauacccuggugucagaugugucugcagagacaacuggaaaggcuccaauaggcccaucguagauauaaaugugaaagauuauagcauuguuuccaguuaugugugcucagggcuuguuggagacacacccagaaaaaacgacagauccagcaguagcuauugccggaauccuaauaaugagaaagggagucauggagugaaaggcugggccuuugacgauggaaaugacguguggaugggaagaacgaucggcgaggaguuacgcucagguuaugaaaccuucaaagucauuggagguugguccacaccuaacuccaaauugcagauaaauaggcaagucauaguugacagcgguaauagguccgguuauucugguauuuucucuguugagggcaaaagcugcaucaaucggugcuuuuauguggaguugauaaggggaaggaaacaggaaacuagagucugguggaccucaaacaguauuguuguguuuugcggcaccucagguacauauggaacaggcucauggccugauggggcggacaucaaucucaugccuauauaa

SEQ ID NO: 47034 - RNA, 1410 nt, Artificial Sequence
  neuraminidase__InfluenzaA__ACI26585
augaauccaaaucaaaagauaauaacaauuggcucuguuucucucaccauugccacaauaugcuuccuuaugcaaauugccauccugguaacuacuguaacauugcauuucaagcaacaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauguccucaggacccaggagucggaaugcguuuguauaaauggaacuuguacaguaguaaugacugauggaagugcuucagaaagagcugauacuaaaauacuauucauugaagaggggaaaaucguucauauuagcccguugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagccauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 47035 - RNA, 1413 nt, Artificial Sequence
  neuraminidase__InfluenzaA__ACI32764
augaauccaaaucaaaaaauaauaaccauuggaucaaucaguauggcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccaguuacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47036 - RNA, 1413 nt, Artificial Sequence
  neuraminidase__InfluenzaA__ACI32765
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacaacaccugggugaaucacacauauguuaauauuaacaacacuaauguaguugcuagaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuuaugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaguagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47037 - RNA, 1413 nt, Artificial Sequence
  neuraminidase__InfluenzaA__ACI32766
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaagcauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccugcuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47038 - RNA, 1413 nt, Artificial Sequence
  neuraminidase__InfluenzaA__ACI32767
augaauccaaaucaaaaaauaauaaccauuggaucaaucaguauagcaaucggaauaauuagucuaauguugcaaauaggaaauauuauuucaauaugggcuagucacucaacccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcguaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccugcuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47039 - RNA, 1413 nt, Artificial Sequence
  neuraminidase__InfluenzaA__ACI32768
augaauccaaaucaaaaaauaauaaccauuggaucaaucaguauagcaaucggaauaauuagucuaaugucgcaaauaggaaauauuauuucaauaugggcuagucacucaauccaaacuggaagucaaaaccacacuggaauaugcaaccaaagaaucaucacauaugaaaacagcaccugggugaaucacacauauguuaauaucaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47040 - RNA, 1413 nt, Artificial Sequence
  neuraminidase__InfluenzaA__ACI32769
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucaccuaugaaaacagcaccugggugaaucacacauauguuaauauuaacaacacuaauguuguugcuggaaaggacaaaauuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccaaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuuuguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47041 - RNA, 1413 nt, Artificial Sequence
  neuraminidase__InfluenzaA__ACI32770
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggggcagacggaguuaagggguuuucauacaaauaugguaaugguguuuggauaggaaggacuaaaaguaacagacuuagaaaggguuuugagaugauuugggauccuaauggguggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47042 - RNA, 1413 nt, Artificial Sequence
  neuraminidase__InfluenzaA__ACI32771
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauauaaaaacagcaccugggugaaucacacauauguuaauauuaacaacacuaauguuguugcuggaaagggcaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47043 - RNA, 1413 nt, Artificial Sequence
  neuraminidase__InfluenzaA__ACI32772
augaauccaaaucaaaaaauaauaaccauuggaucaaucaguauagcaaucggaauaauuagucuaaugcugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47044 - RNA, 1413 nt, Artificial Sequence; identical to SEQ ID NO: 46741
  neuraminidase__InfluenzaA__ACI32773

SEQ ID NO: 47045 - RNA, 1413 nt, Artificial Sequence
  neuraminidase__InfluenzaA__ACI32774
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuuccuuuuguggcguugauagugauacugcaaacuggucuuggccagacggugcugaguugccguucaccauugacaaguag

SEQ ID NO: 47046 - RNA, 1413 nt, Artificial Sequence; identical to SEQ ID NO: 46741
  neuraminidase__InfluenzaA__ACI32775

SEQ ID NO: 47047 - RNA, 1413 nt, Artificial Sequence
  neuraminidase__InfluenzaA__ACI32776
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauauaaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47048 - RNA, 1413 nt, Artificial Sequence
  neuraminidase__InfluenzaA__ACI32777
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauauaaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaagggaaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaaggguuuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucgccauugacaaguag

SEQ ID NO: 47049 - RNA, 1413 nt, Artificial Sequence; identical to SEQ ID NO: 46741
  neuraminidase__InfluenzaA__ACI32778

SEQ ID NO: 47050 - RNA, 1413 nt, Artificial Sequence
  neuraminidase__InfluenzaA__ACI32779
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaacguuguugcuggaaaggacaaaacuucagugacauuggccggcaauucaucucuuugcucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagccccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuuccuuuuguggcguugauagugauacugcaaacuggucuuggccagacggugcugaguugccguucaccauugacaaauag

SEQ ID NO: 47051 - RNA, 1413 nt, Artificial Sequence; identical to SEQ ID NO: 47050
  neuraminidase__InfluenzaA__ACI32780

SEQ ID NO: 47052 - RNA, 1413 nt, Artificial Sequence; identical to SEQ ID NO: 47050
  neuraminidase__InfluenzaA__ACI32781

SEQ ID NO: 47053 - RNA, 1413 nt, Artificial Sequence
  neuraminidase__InfluenzaA__ACI32782
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauggggccgccucguacaaaaucuucaagauugaaaaggggaaggcuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagaaagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47054 - RNA, 1413 nt, Artificial Sequence
  neuraminidase__InfluenzaA__ACI32783
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcaaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugguugucuuuuaaucaaaacuuggauuaucaaauaggauauaucugcaguggagugaucggugacaauccgcgucccaaagauggaaagggcagcuguaauccagugacuguugauggagcugacggaguuaagggguuuucauacaaauaugguaaugguguuuggauaggaaggacuaaaaguaacagacuuagaaagggguuugagaugauuugggauccuaauggauggacagauaccgacagcgauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauggugauacugcaaacuggucuuggccagacggugcugaguugccguucaccauugacaaauag

SEQ ID NO: 47055 - RNA, 1413 nt, Artificial Sequence
  neuraminidase__InfluenzaA__ACI32784
augaacccaaaucaaaagauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauggggccgccucguacaaaaucuucaagauugaaaaggggaaggcuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47056 - RNA, 1413 nt, Artificial Sequence
  neuraminidase__InfluenzaA__ACI32785
augaauccaaaucaaaaaauaauaaccauuggaucaaucaguauagcaaucggaauaauuagucuaauguugcaaauaggaaauauuauuucaauaugggcuagucauucaauccaaacuggaagucaaaaccacacuggaaugugcaaccaaagaaucaucacauaugaaaacagcaccugggugaaucacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggagccgccucguacaaaaucuucaagaucgaaaaggggaagguuacuaaaucaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaaggacuaaaaguaacagacuuagaaagggguuugagaugauuugggauccuaauggaugggcagauaccgacagugauuucucagugaaacaggauguuguggcaauaacugauuggucaggguacaguggaaguuucguucaacauccugaguuaacaggauuaaacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 47057 - RNA, 1413 nt, Artificial Sequence
  neuraminidase__InfluenzaA__ACI32787
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucaucacauaugaaaacagcaccugggugaauaacacauauguuaauauuaacaacacuaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaauggggccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaagggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuuuguucaacauccugaguuaacaggauuggacuguauaagacccugcuucuggguugaguuagucagagggcugccuagggaaaauacaacaaucuggacuagugggagcagcauuucuuuuuguggcguuaauggugguacugcagacuggucuuggccagacggugcugaguugccguucaccauugacaaguag

SEQ ID NO: 47058 - RNA, 1413 nt, Artificial Sequence
  neuraminidase__InfluenzaA__ACI32788
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaacaugcaaccaaagaaucaucacauaugaaaacaacaccugggugaaucacacauguguuaauauuaacaacacuaauguuguugcuggaaaggacaaaacuucagugacacuggucggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcuguccucuaggugaagccccguccccauacaauucaaaguuugaaucaguugcauggucagcaagcgcaugccaugauggcaagggcugguuaacaaucggaauuucugguccagacaauggagcuguggcuguacuaaaauacaacggaauaauaacugaaaccauaaaaaguuggaaaaagcgaauauugagaacacaagaaucugaauguguuugugugaacgggucauguuucaccauaaugaccgauggcccgaguaauggggccgccucguacaaaaucuucaagaucgaaaaggggaagguuacuaaaucaauagaguugaaugcaccuaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccaaugacuguugauggagcagacggaguuaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguccaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47059 - RNA, 1410 nt, Artificial Sequence
  neuraminidase__InfluenzaA__ACI32790
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacuggauuugcaccuuuuucuaaggacaauucgauucggcuuuccgcugguggggacaucuggguuacacgagaaccuuaugugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagguaauagguccgguuauucugguauuuucucuguugaaggcaaaagcugcaucaaucggugcuuuuauguggagcugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 47060 - RNA, 1410 nt, Artificial Sequence
  neuraminidase__InfluenzaA__ACI32791
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguuguguuuuguggcaccucagguacauauggaacaggcucauggccugauggggcggacaucaaucucaugccuauauaa

SEQ ID NO: 47061 - RNA, 1410 nt, Artificial Sequence
  neuraminidase__InfluenzaA__ACI32793
augaauccaaaucaaaaaauaauaacgauuggcucuguuucucucaccauugccacaauaugcuuccuuacgcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugcaacauuacuggauuugcaccuuuuucuaaggacaauucgauucggcuuuccgcugguggggacaucuggguuacaagagaaccuuaugugucaugcgauccugacaaguguuaucaauuugcccuuggacagggaacaacacuaaacaacgggcauucaaaugacacaguacaugauaggaccccuuauaggacccuauugaugaaugaguuggguguuccauuucauuugggaaccaagcaagugugcauagcaugguccagcucaaguugucacgauggaaaagcauggcugcauguuuguguaacgggggaugauaaaaaugcaacugcuagcuucauuuacaaugggaggcuuguagauaguauagguucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagccuauugucagggagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaacugcagauaaauaggcaagucauaguugacagagauaauagguccgguuauucugguauuuucucuguugaaggcaaaagcugcaucaaucggugcuuuuauguggaguugauaaggggaaggaaccaggaaacugaagucuuguggaccucaaacaguauuguaguguuuuguggcaccucagguacauauggaacaggcucauggccugauggggcggacaucaaucucaugccuauauaa

SEQ ID NO: 47062 - RNA, 1410 nt, Artificial Sequence; identical to SEQ ID NO: 44886
  neuraminidase__InfluenzaA__ACI32794

SEQ ID NO: 47063 - RNA, 1410 nt, Artificial Sequence; identical to SEQ ID NO: 46236
  neuraminidase__InfluenzaA__ACI32795

SEQ ID NO: 47064 - RNA, 1410 nt, Artificial Sequence
  neuraminidase__InfluenzaA__ACI32796
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguagcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagacauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47065 - RNA, 1410 nt, Artificial Sequence
  neuraminidase__InfluenzaA__ACI32797
augaauccaaaucaaaugauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguagcauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauagaaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugauggaagugcuucaggaaaagcugauacuaaaauacuauucauugaggaggggaaaaucguucauacuagcacauugucaggaagugcucagcaugucgaggagugcuccugcuauccucgauauccuggagucagaugugucugcagagacaacuggaaaggcuccaauaggcccauaguagacauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaagucacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47066 - RNA, 1410 nt, Artificial Sequence
  neuraminidase__InfluenzaA__ACI32798
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaacgaaauccucaggacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucacggagugaaaggcugggccuuugaugauggaaaugacguguggaugggaagaacgaucagcgagaaguuacgcucaggauaugaaaccuucaaagucauugaaggcugguccaaccccaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47067 - RNA, 1410 nt, Artificial Sequence
  neuraminidase__InfluenzaA__ACI32799
augaauccaaaucaaaggauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcuaauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaagaaacugaagucuuguggaccucaaacaguauuguuguauuuuguggaaccucagguacauauggaacaggcucauggccugauggggcggacaucaaucucaugccuauauaa

SEQ ID NO: 47068 - RNA, 1410 nt, Artificial Sequence
  neuraminidase__InfluenzaA__ACI32800
augaauccaaaucaaaagauaauaacgauuggcucuguuucucucaccauuuccacaauaugcuucuucaugcaaauugccaucuugauaacuacuguaacauugcauuucaaacaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47069 - RNA, 1410 nt, Artificial Sequence
  neuraminidase__InfluenzaA__ACI32802
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47070 - RNA, 1410 nt, Artificial Sequence; identical to SEQ ID NO: 47069
  neuraminidase__InfluenzaA__ACI32803

SEQ ID NO: 47071 - RNA, 1410 nt, Artificial Sequence
  neuraminidase__InfluenzaA__ACI32804
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaucaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 47072 - RNA, 1410 nt, Artificial Sequence
  neuraminidase__InfluenzaA__ACI32805
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugucucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugccacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcuguuacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgaccgcuccagcaguagccauugcuuggauccuaacaaugaagaagguggucauggagugaaaggcugggccuucgaugauggaaaugacguguggaugggaagaacgaucagcgagaagucacgcucaggauaugaaaccuucaaagucauugaaggcugguccaacccuaauuccaaauugcagacaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47073 - RNA, 1410 nt, Artificial Sequence
  neuraminidase__InfluenzaA__ACI32806
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacgguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 47074 - RNA, 1410 nt, Artificial Sequence
  neuraminidase__InfluenzaA__ACI32807
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaguaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggauaugaaaccuucaaagucauugaaggcugguccaacccuaauuccaaauugcagauaaauaggcaagucauaguugacagagguaauaggucagguuauucugguauuuucucuguugaaggcaaaagcugcaucaaucggugcuuuuauguggaguugauaaggggaagaaaagaagaaacugaagucuuguggaccucaaacaguauuguuguguuuuguggcaccucagguacauauggaacaggcucauggccugauggggcggacaucaaucucaugccuauauaa

SEQ ID NO: 47075 - RNA, 1410 nt, Artificial Sequence
  neuraminidase__InfluenzaA__ACI32808
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagagaaaacugaagucuuguggaccucaaacaguauuguuguauuuuguggaaccucagguacauauggaacaggcucauggccugauggggcggacaucaaucucaugccuauauaa

SEQ ID NO: 47076 - RNA, 1410 nt, Artificial Sequence
  neuraminidase__InfluenzaA__ACI32809
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 47077 - RNA, 1410 nt, Artificial Sequence
  neuraminidase__InfluenzaA__ACI32810
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccucaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaauggaaggcuuguagauaguguuguuucaugguccaaagauauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguauuuuguggaaccucagguacauauggaacaggcucauggccugauggggcggacaucaaucucaugccuauauaa

SEQ ID NO: 47078 - RNA, 1410 nt, Artificial Sequence
  neuraminidase__InfluenzaA__ACI32811
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaaaccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaguguuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacaaucagcgagaaguuacgcucaggauaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcugauaucaaucucaugccuauauaa

SEQ ID NO: 47079 - RNA, 1410 nt, Artificial Sequence
  neuraminidase__InfluenzaA__ACI32812
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaacgacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacaggggaugauaaaaaugcaacugcuagcuucauuuacaaugggaggcuuguagauaguguuguuucaugguccaaagauauccucaggacccaggagucagaaugcguuuguaucaauggaacuuguacaguaguaaugacugaugggagugcuucaggaaaagcuaauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaagaauuauagcauuguuuccaguuaugugugcucaggacuuguuggagacacacccagaaaaaccgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaagaaacugaagucuuguggaccucaaacaguauuguuguauuuuguggaaccucagguacauauggaacaggcucauggccugauggggcggacaucaaucucaugccuauauaa

SEQ ID NO: 47080 - RNA, 1410 nt, Artificial Sequence
  neuraminidase__InfluenzaA__ACI32814
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuuccaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacagcauuguuguguuuuguggcaccucagguacauauggaacaggcucauggccugauggggcggacaucaaucucaugccuauauaa

SEQ ID NO: 47081 - RNA, 1350 nt, Artificial Sequence
  neuraminidase__InfluenzaA__ACJ53848
augaauccaaaucagaagauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuucuuacugagaaagcuguggcuucagugacauuagcgggcaauucaucucuuugucccauuagcggaugggcuguauacaguaaggacaacaguauaaggaucggcuccaggggggauguauuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaguacaauggcauaauaacagacaccaucaagaguuggaggaacaacauacugagaacucaagagucugaaugugcauguguaaauggcucuugcuuuacuguaaugacugauggaccaaguaguggccaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauaugggguaaaaggguuuucauuuaaauacggcaaugguguuuggaucgggagaaccaaaagcacuaauuccaggagcggcuuugagaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47082 - RNA, 1350 nt, Artificial Sequence
  neuraminidase__InfluenzaA__ACJ53849
augaauccaaaucagaagauaauaaccaucggaucaaucuguaugguaauuggaauaguuagcuuaauguuacaaauugggaacaugaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuacgaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguuguaguccgguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47083 - RNA, 1350 nt, Artificial Sequence
  neuraminidase__InfluenzaA__ACJ53853
augaauccaaaucagaagauaauaaccaucggaucaaucuguaugguaauuggaauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauauaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuuuggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47084 - RNA, 1350 nt, Artificial Sequence
  neuraminidase__InfluenzaA__ACJ53866
augaauccaaaucagaagauaauaaccaucggaucaaucuguaugguaauuggaauaguuagcuuaauguuacaaauugggaacaugaucucaauaugggucagccauucaauucagacaggaaaucaaugccaagaugaaccaaucagcaacacuaaauuucuuacugagaaagcuguggcuucaguaacauuagcgggcaauucaucucuuugucccauuagcggaugggcuguauacaguaaggacaacaguauaaggaucgguuccaggggagauguguuuguuauaagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaaguggucaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaauaucaaauaggauauauaugcaguggaguuuucggagacaauccacgccccaaugauggaacagguaguugugguccgguguucccuaacggggcauaugggguaaaaggguuuucguuuaaauacggcaaugguguuuggaucgggagaaccaaaagcacuaauuccaggagcggcuuugaaaugauuugggaccccaauggguggacuggaacggacaguagcuuuucggugaagcaagauaucguagcaauaacugauuggucaggauauagcgggaguuucguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47085 - RNA, 1350 nt, Artificial Sequence
  neuraminidase__InfluenzaA__ACJ53867
augaauccaaaucagaagauaauaaccaucggaucaaucuguauggcaauuggaauaguuagcuuaauguuacaaauugggaacaugaucucacuaugggucagucauucaauucagacagggaaucaaugccaagcugaaccaauuagcaauacuaaauuucuuacugagaaagcuguggcuucaguaacauuagcgggcaauucaucucuuugucccauuagcggaugggcuguauacaguaaagacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacacaagagucugaaugugcauguguaaaugguucuugcuucacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugcgguccgguguccccuaacggggcauaugggguaaaaggguuuucauuuaaauacggcaaugguguuuggaucgggagaaccaaaagcacuaauucuaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggacuaguggaagcagcauaucuuuuugugguguaaauagugacacuguuaguuggucuuggccagacggugcugaguugccauucaccauugacaaguag

SEQ ID NO: 47086 - RNA, 1350 nt, Artificial Sequence
  neuraminidase__InfluenzaA__ACJ53875
augaauccaaaucagaagauaauaaccaucggaucaaucuguaugguaauuggaauaguuagcuuaauguuacagauugggaacaugaucucaauaugggucagucauucaauucagacagggaaucaaugccaagcugaaccgaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaaugggacugucaaagacagaagcccucacagaacauuaaugaguuguccugugggugaggcucccuccccauauaacucaagguuugagucuguugcuuggucagcuagugcuugccaugauggcaucaguugguugacaauuggaauuucugguccagacaauggggcuguagcuguauugaaauacaauggcauaauaacagacaccaucaagaguuggaggaacaacauacuaagaacucaagaaucugaaugugcauguguaaauggcucuugcuuuacuguaaugacugauggaccaaguagugggcaggcaucauauaagaucuucaaaauggaaaaaggaaaagugguuaaaucagucgaauuggaagcuccuaauuaucacuaugaggagugcuccuguuauccugaugccggcgaaaucacauguguguguagggauaauuggcauggcucaaauaggccauggguaucuuucaaucaaaaucuggaguaucaaauaggauauauaugcaguggaguuuucggagacaauccacgccccaaugauggaacagguaguugugguccaguguccccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagugggaguuuuguccagcauccagaacugacaggauuagauugcauaagaccuuguuucuggguugaguuaaucagagggcggccuaaagagagcacaauuuggaccaguggaagcagcauauccuuuugugguguaaauagugacacuguuaguuggucuuggccagacggugcugaguugccauucaccauugacaaguag

SEQ ID NO: 47087 - RNA, 1350 nt, Artificial Sequence
  neuraminidase__InfluenzaA__ACJ53876
augaauccaaaucagaagauaauaaccaucggaucaaucuguaugguaauuggaauaguuagcuuaauguuacaaauugggaacauaaucucaauaugggucagucauucaauucagacagggaaucaaugccaagcugaaccaaucagcaauacuaaauuucuuacugagaaagcuguggcuucaguaacauuagcgggcaauucaucucuuugucccauuagcggaugggcuguauacaguaaggacaacaguauaaggaucgguuccaggggggauguguuuguuauaagagagccguucaucucaugcucccacuuggaaugcagaacuuucuuuuugacucagggagccuugcugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggagugcuccuguuauccugaugccggcgaaaucacaugugugugcagggauaauuggcauggcucaaauaggccauggguaucuuucaaucaaaauuuggaguaucaaauaggauauauaugcaguggaguuuucggagacaauccacgccccaaugauggaacagguaguugugguccgguguccccuaacggggcauauggaguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuugcuucuggguugaguuaaucagagggcggccuaaagagagcacaauuuggaccaguggaagcagcauaucuuuuugugguguaaauagcgacacuguugguuggucuuggccagacggugcugaguugccauucaccauugacaaguag

SEQ ID NO: 47088 - RNA, 1404 nt, Artificial Sequence
  neuraminidase__InfluenzaA__ACJ67535
augaauccaaaucaaaagauaauagcacuuggcucuguuucuauaacuauugcgacaauauguuuaaucaugcagauugccgucuuagcaacgacuaugacacuacauuucaacgaaugcaccaacccaucgaacaaucaagcaaugccaugugaaccaaucauaauagaaaggaacaugacagagauagugcauuugaauaauacuaccauagagaaggaaaguuguccuaaaguagcagaauacaagaauuggucaaaaccgcaaugucaaauuacaggguucgccccuuucuccaaggacaacucaauuaggcuuucugcaggcggggauauuugggugacaagagaaccuuauguaucgugcggucuugguaacuguuaccaauuugcacuugggcagggaaccacuuugaacaacaaacacucaaaugacacaauacaugauaggaguccccauagaacccuuuuaaugaacgaguuagguguuccauuucauuugggaaccaaacaagugugcauagcaugguccagcucaagcugccaugaugggaaagcaugguuacauguuugugucacuggggaugauagaaaugcgacugcuagcaucauuuaugaugggaugcuuaccgacaguauugguucauggucuaagaacauccucagaacucaggagucagaaugcguuugcaucaauggaacuuguacaguaguaaugacugauggaagugcaucaggaagggcugauacuaaaauacuauucauuagagaagggaaaauuguccacauuaguccacugucaggaagugcucaacauguggaggaaugcuccuguuacccccgguauccagaaguuagauguguuugcagagacaauuggaagggcuccaauagacccgugcuauauauaaauguggcagauuauaguguugauucuaguuaugugugcucaggacuuguuggcgacacaccaagaaaugacgauagcuccagcagcaguaacugcagggaucccaauaacgagagagggggcccaggagugaaagggugggccuuugacaauggaaaugauguuuggaugggacgaacaaucaagaaagauucgcgcucugguuaugagacuuucagggucguuggugguuggacuacggcuaauuccaagucacaaauaaauaggcaagucauaguugacagugauaacuggucuggguauucugguauauucucuguugaaggaaaaaccugcaucaacagguguuuuuauguggaguugauaagagggagaccacaggagaccagaguaugguggacuucaaauagcaucauuguauuuuguggaacuucagguaccuauggaacaggcucauggccugauggagcgaauaucaauuucaugucuauauaa

SEQ ID NO: 47089 - RNA, 1410 nt, Artificial Sequence
  neuraminidase__InfluenzaA__ACK99424
augaauccaaaucaaaagauaauaacaauuggcucuguuucucucacuauugccacaauaugcuuccuuaugcaaauugccauccugguaacuacuguaacauugcauuucaagcaauaugagugcagcucccccccaaacaaccaaguaauuccaugucaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuagcaaauguuaucaauuugcacuuggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauugguucaugguccaaaaauauccucaggacccaggagucggaaugcguuuguaucaaugggacuuguacaguaguaaugacugauggaagugcuucagaaagagcugauacuaaaauacuauucauugaagaggggaaagucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucagcgaggaguuacgcucagguuaugaaaccuucaaagucauuggagguugguccacaccuaauuccaaauugcagauaaauaggcaagucauaguugacagcgguaauagguccgguuauucugguauuuucucuguugaaggcaaaagcugcaucaaucggugcuuuuauguggaguugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 47090 - RNA, 1410 nt, Artificial Sequence
  neuraminidase__InfluenzaA__ACK99435
augaauccaaaucaaaagauaauaacaauuggcucugucucucucaccauugcaacaguaugcuuccucaugcagauugccauccugguaacuacuguaacauugcauuuuaagcaacaugagugcgacucccccgcgagcaaccaaguaaugccgugugaaccaauaauaauagaaaggaacauaacagagauaguguauuugaauaacaccaccauagagaaagagaucugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguguagcaugguccagcucaaguugucacgauggaaaagcaugguugcauguuugugucacuggggaugauaaaaaugcaacugcuagcuucauuuaugacgggaggcuuauggacaguauugguucauggucucaaaauauccucaggacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaggaguguuccuguuauccucgauauccugacgucagauguaucugcagagacaacuggaaaggcucuaauaggcccgucauagacauaaauauggaagauuauagcauugauuccaguuaugugugcucagggcuuguuggcgacacacccagaaacgacgacagaucuagcaauaguaauugcaggaauccuaacaaugagagaggaaauccaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaggucauaguugacagcaauaauuggucagguuacucugguauuuucucuguugagggcaaaagaugcaucaauaggugcuuuuauguggaguugauaaggggaaggcaacaggagacuagaguaugguggaccucaaacaguauuguuguguuuuguggcacuucagguacuuauggaacaggcucauggccugauggggcgaacaucaauuucaugccuauauaa

SEQ ID NO: 47091 - RNA, 1413 nt, Artificial Sequence
  neuraminidase__InfluenzaA__ACK99446
augaauccaaaucaaaaaauaauaaccauuggaucaaucaguauggcaaucggaauaauuagucuaacauugcaaauaggaaauauuauuucaauauggguuagccacucaauccaaacuggaagucaaaaccacacuggaauaugcaaccaaagaaucauuacauaugaaaauagcaccugggugaaucaaacauauguuaauauuaacaacacuaauguuguugcuggaaaggacaaaacuucagugacauuggccggcaauucaucucuuuguccuauccgugggugggcuauauacacaaaagacaacagcauaagaauugguuccaaaggagauguuuuugucauaagagaaccuuuuauaucauguucucacuuggaaugcagaaccuuuuuucugacccaaggugcucuauuaaaugacaagcauucaaaugggacuguuaaggacagaagcccucauagggccuuaaugagcuguccucuaggugaagcuccgucuccauacaauucaagguuugaaucaguugcuuggucagcaagcgcaugccaugauggcaugggcuggcuaacaaucggaauuucugguccagaugauggagcaguggcuguacuaaaauacaacggcauaauaacugaaaccauaaaaaguuggaagaagcgaauauuaagaacacaagagucugaaugugucuguguaaacgguucauguuuuaccauaaugaccgauggcccgaguaauggggccgccucguacagaaucuucaaaaucgagaaggggaagguuacuaaaucaauagaguuggaugcacccaauucucauuacgaggaauguuccuguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggaaaaggcagcuguaauccagugacuguugauggagcagacggaguaaagggguuuucauacagauaugguaaugguguuuggauaggaaggacuaaaaguaacagauucagaaagggauuugagaugauuugggauccuaauggauggacagauaccgacagugauuucucagugaaacaggauguaguggcaaugacugauuggucaggguacagcggaaguuucguucaacauccugagcuaacaggauuggacuguaugagaccuugcuucuggguugaauuagucagagggcggccuagagaaaauacaacaaucuggacuagugggagcagcauuucuuuuuguggcgugaauagcgauacugcaaacuggucuuggccagacggugccgaguugccguucaccauugacaaguag

SEQ ID NO: 47092 - RNA, 1410 nt, Artificial Sequence
  neuraminidase__InfluenzaA__ACK99457
augaauccaaaucaaaagauaauaacaauuggcucuguuucucucaccauugccacaauaugcuuccuuaugcaaauugccauccugguaacuacuguaacauugcauuucaagcaacaugagugcaacucccccccaaacaaccaaguaaugccgugugaaccaacaauaauagaaagaaacauaacagagauaguguauuugacuaacaccaccauagagaaagagauaugccccaaacuaguagaauacagaaauuggucaaagccgcaauguaaaauuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguauaaauggaacuuguacaguaguaaugacugauggaagugcuucagaaagagcugauacuaaaauacuauucauugaagaggggaaaaucguucauauuagcccguugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagccauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 47093 - RNA, 1413 nt, Artificial Sequence
  neuraminidase__InfluenzaA__ACK99468
augaauccaaaucaaaaaauaauaaccauuggaucaaucaguauugcaauuggaauaauuagucugauauugcaaauaggaaauauuauuucaauaugggcuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaaccucaaugacauuggccggcaauucaucucuuugcccuauccguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagauuugaaucaguugcuuggucagcaagcgcaugccaugauggcuugggcuggcuaacaaucggaauuucugguccagauaauggggcaguggcuguacuaaaauacaacggcauaauaacugaaaccauuaaaaguuggaagaagcgaauauuaagaacacaagagucugaaugugucuguaugaacaguucauguuuuaccauaaugaccgauggcccgaguaauggggccgcaucguacagaaucuucaaaaucgagaaggggagaguuacuaaaucaauagaguuggaugcacccaauuaucauuacgaagaauguucauguuacccagacaccggcacagugaugugugugugcagggacaauuggcacgguucaaaucgaccuugggugucuuuuaaucaaaaccuggauuaucaaauaggauacaucugcagugggguguucggugacaauccgcgucccaaagauggagaaggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucaaugaaacaggauaucguggcaaugacugauuggucaggguacagcggaaguuuuguucaacauccugagcuaacaggauuggacuguaugagaccuugcuucuggguugaauuagucagagggcuaccuagagaaaauacaacaaucuggacuagugggagcagcauuucuuuuuguggcguaaauagcgauacugcaaacuggucuuggccagacggugccgaguugccauucaccauugacaaguag

SEQ ID NO: 47094 - RNA, 1410 nt, Artificial Sequence
  neuraminidase__InfluenzaA__ACK99479
augaauccaaaucaaaagauaauaacgauuggcucuguuucucucacuauugccacaauaugcuuccuuaugcaaauugcaauccugguaacuacuguaacauugcauuucaagcaauaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaaaauuacaggauuugcaccuuuuucuaaggacaauucaauucggcuuuccgcugguggggacauuugggugacaagagaaccuuaugugucaugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauauuagcccauuguuaggaagugcucagcaugucgaggagugcuccuguuauccucgauauccuggugucagaugugucugcagagacaacuggaaaggcuccaauaggcccaucguagauauaaauguaaaggauuauaguauuguuuccaguuaugugugcucaggacuuguuggagacacacccagaaaaaacgacagcuccagcaguagccauugccugaauccuaacaaugaggaagggggucauggagugaaaggcugggccuuugaugauggaaaugacguguggaugggaagaacgaucagcgagaaguuacgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcgaacaucaaucucaugccuauauaa

SEQ ID NO: 47095 - RNA, 1413 nt, Artificial Sequence; identical to SEQ ID NO: 46788
  neuraminidase__InfluenzaA__ACL12066

SEQ ID NO: 47096 - RNA, 1410 nt, Artificial Sequence
  neuraminidase__InfluenzaA__ACL12132
augaauccaaaucaaaagauaauaacaauuggcucuguuucucucacuauugccacaauaugcuuccuuaugcaaauugccauccugguaacuacuguaacauugcacuucaagcaauaugagugcaacucccccccaaacaaccaaguaaugcugugugaaccaacaauaauagaaagaaacauaacagagauaguguaucugaccaacaccaccauagagaaagaaauaugccccaaacuagcagaauacagaaauuggucaaagccgcaauguaaaauuacaggauuugcaccuuuuucuaaggacaauucaauucggcuuucagcugguggagacauuugggugacaagagaaccuuaugugucaugcgauccuggcaaguguuaucaauuugcccuuggacagggaacaacacuaaacaacaggcacucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcaugucgaggagugcuccuguuauccucgauauccuggugucagaugugucugcagagacaacuggaaaggcuccaauaggcccaucguagauauaaaugugaaagauuauagcauuguuuccaguuaugugugcucaggacuuguuggagacacacccagaaaaaacgacagcuccagcaguagcuauugccggaauccuaacaaugagaaagggagucauggagugaaaggcugggccuuugaugauggaaaugacguguggaugggaagaacgaucagcgaggaguuacgcucagguuaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 47097 - RNA, 1413 nt, Artificial Sequence; identical to SEQ ID NO: 47022
  neuraminidase__InfluenzaA__ACL12154

SEQ ID NO: 47098 - RNA, 1410 nt, Artificial Sequence
  neuraminidase__InfluenzaA__ACL12165
augaauccaaaucaaaagauaauaacgauuggcucuguuucucucaccauuuccacaauaugcuucuucaugcaaauugccaucuugauaacuaccguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47099 - RNA, 1410 nt, Artificial Sequence; identical to SEQ ID NO: 47098
  neuraminidase__InfluenzaA__ACL12176

SEQ ID NO: 47100 - RNA, 1410 nt, Artificial Sequence
  neuraminidase__InfluenzaA__ACL12198
augaauccaaaucaaaagauaauaacgauuggcucuguuucucucaccauuuccacaauaugcuucuucaugcaaauugccaucuugauaacuacuguaacauugcauuucaagcaauaugaauucaacuccaccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47101 - RNA, 1410 nt, Artificial Sequence
  neuraminidase__InfluenzaA__ACL12209
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguucgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuacguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47102 - RNA, 1410 nt, Artificial Sequence; identical to SEQ ID NO: 47018
  neuraminidase__InfluenzaA__ACL12220

SEQ ID NO: 47103 - RNA, 1410 nt, Artificial Sequence
  neuraminidase__InfluenzaA__ACL12242
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47104 - RNA, 1413 nt, Artificial Sequence
  neuraminidase__InfluenzaA__ACL12264
augaauccaaaucagaaaauaauaaccauuggaucaaucaguauggcaaucggaauaauuagccuaauauugcaaauaguaaauauuauuucaauauggguuagccacucaauccaaacuggaagucaaaaccacacuggaauaugcaaccaaagaaucauuacauaugaaaauagcaccuggguaaaucaaacauauguuaauauuaacaacacuaauguuguugcuggaaaggacaaaacuucagugacauuggccggcaauucaucucuuuguccuauccgugggugggcuauauacacaaaagacaacagcauaagaauugguuccaaaggagauguuuuugucauaagagaaccuuuuauaucauguucccacuuggaaugcagaaccuuuuuucugacccaaggugcucuauuaaaugacaagcauucaaaugggaccguuaaggacagaagcccuuauagggccuuaaugagcuguccucuaggugaagcuccgucuccauacaauucaagguuugaaucaguugcuuggucagcaagcgcaugccaugauggcaugggcuggcuaacaaucggaauuucugguccagaugauggagcaguggcuguacuaaaauacaacggcauaauaacugaaaccauaaaaaguuggaagaagcgaauauuaagaacacaagagucugaaugugucuguguaaacgguucauguuuuaccauaaugaccgauggcccgaguaauggggccgccucguacagaaucuucaaaaucgagaaggggaagguuacuaaaucaauagaguuggaugcacccaauucucauuacgaggaauguuccuguuacccagacaccggcacagugaugugugugugcagagacaauuggcaugguucaaaucgaccuugggugucuuuuaaucaaaaccuggauuaucaaauaggauacaucugcagugggguguucggugacaauccgcgucccaaagauggaaaaggcagcugugauccagugacuguugauggagcagacggaguaaagggguuuucauacagauaugguaaugguguuuggauaggaaggaccaaaaguaacagauucagaaagggauuugagaugauuugggauccuaauggauggacagauaccgacagugauuucucagugaaacaggauguaguggcaaugacugauuggucaggguauagcggaaguuucguucaacauccugagcuaacaggauuggacuguaugagaccuugcuucuggguugaauuagucagagggcggccuagagaaaauacaacaaucuggacuagugggagcagcauuucuuuuuguggcgugaauagugauacugcaaacuggucuuggccagacggugccgaguugccauucaccaucgacaaguag

SEQ ID NO: 47105 - RNA, 1410 nt, Artificial Sequence; identical to SEQ ID NO: 47090
  neuraminidase__InfluenzaA__ACN32275

SEQ ID NO: 47106 - RNA, 1410 nt, Artificial Sequence
  neuraminidase__InfluenzaA__ACN32286
augaauccaaauaaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacggagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauuguuaggaagugcucagcaugucgaggaaugcuccugcuauccucgauauccuggugucagaugugucugcagagacaacuggaaaggcuccaauaggcccaucguagauauaaacauaaaggaucauagcauuguguccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47107 - RNA, 1410 nt, Artificial Sequence
  neuraminidase__InfluenzaA__ACN32493
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47108 - RNA, 1410 nt, Artificial Sequence
  neuraminidase__InfluenzaA__ACN32526
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccacaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauaucccggugucagaugugucugcagagacaacuggaaaggcuccaauaggcccaucguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 47109 - RNA, 1410 nt, Artificial Sequence
  neuraminidase__InfluenzaA__ACN32537
augaauccaaaucaaaagauaauaacaauuggcucuguuucucucaccauugccacaauaugcuuccuuaugcaaauugccauccugguaacuacuguaacauugcauuucaagcaguaugaaugcaacucccccccaaacaaccaaguaaugcugugugaaccaacaauaauagaaagaaacauaacagagauaguguaucugaccaauaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugaugaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucaggaagugcucagcaugucgaggagugcuccuguuauccucgauauccugaugucagaugugucugcagagacaacuggaaaggcuccaauaggcccaucguagauauaaauguaaaggauuauaguauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgauggcugguccaaaccuaacuccaaauuacagauaaauaggcaagucauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 47110 - RNA, 1413 nt, Artificial Sequence; identical to SEQ ID NO: 46586
  neuraminidase__InfluenzaA__ACN32807

SEQ ID NO: 47111 - RNA, 1413 nt, Artificial Sequence; identical to SEQ ID NO: 46540
  neuraminidase__InfluenzaA__ACN32818

SEQ ID NO: 47112 - RNA, 1413 nt, Artificial Sequence; identical to SEQ ID NO: 46557
  neuraminidase__InfluenzaA__ACN32829

SEQ ID NO: 47113 - RNA, 1413 nt, Artificial Sequence
  neuraminidase__InfluenzaA__ACN32840
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaagaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacuguaaacuggucuuggccagacggugcugaguugccguucaccauugacaaguag

SEQ ID NO: 47114 - RNA, 1410 nt, Artificial Sequence
  neuraminidase__InfluenzaA__ACN32851
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugacaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacaucagguacauauggaacaggcucauggccugauggggcggacaucaaucucaugccuauauaa

SEQ ID NO: 47115 - RNA, 1410 nt, Artificial Sequence; identical to SEQ ID NO: 47103
  neuraminidase__InfluenzaA__ACN32862

SEQ ID NO: 47116 - RNA, 1410 nt, Artificial Sequence
  neuraminidase__InfluenzaA__ACN32873
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggagauaugccccaaacuagcagaauacagaaauuggucaaagccgcaaugugacauuacaggauuugcaccuuuuucuaaggacaauucgauuaggcuuuccgcugguggggacaucugggugacgagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47117 - RNA, 1410 nt, Artificial Sequence; identical to SEQ ID NO: 47103
  neuraminidase__InfluenzaA__ACN32884

SEQ ID NO: 47118 - RNA, 1410 nt, Artificial Sequence
  neuraminidase__InfluenzaA__ACN32895
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucggaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggaaugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuacguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47119 - RNA, 1410 nt, Artificial Sequence
  neuraminidase__InfluenzaA__ACN32906
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucagcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47120 - RNA, 1410 nt, Artificial Sequence
  neuraminidase__InfluenzaA__ACN32917
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuguguaaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaacggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47121 - RNA, 1410 nt, Artificial Sequence
  neuraminidase__InfluenzaA__ACN32928
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaacggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47122 - RNA, 1410 nt, Artificial Sequence; identical to SEQ ID NO: 47107
  neuraminidase__InfluenzaA__ACN32939

SEQ ID NO: 47123 - RNA, 1410 nt, Artificial Sequence; identical to SEQ ID NO: 47018
  neuraminidase__InfluenzaA__ACN32950

SEQ ID NO: 47124 - RNA, 1410 nt, Artificial Sequence
  neuraminidase__InfluenzaA__ACN32961
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaacggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaauaucaugccuauauaa

SEQ ID NO: 47125 - RNA, 1410 nt, Artificial Sequence
  neuraminidase__InfluenzaA__ACN32972
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggagaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47126 - RNA, 1410 nt, Artificial Sequence; identical to SEQ ID NO: 47103
  neuraminidase__InfluenzaA__ACN32994

SEQ ID NO: 47127 - RNA, 1410 nt, Artificial Sequence
  neuraminidase__InfluenzaA__ACN33005
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcgaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47128 - RNA, 1410 nt, Artificial Sequence
  neuraminidase__InfluenzaA__ACN33016
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47129 - RNA, 1410 nt, Artificial Sequence; identical to SEQ ID NO: 47103
  neuraminidase__InfluenzaA__ACN33049

SEQ ID NO: 47130 - RNA, 1410 nt, Artificial Sequence; identical to SEQ ID NO: 47103
  neuraminidase__InfluenzaA__ACN33060

SEQ ID NO: 47131 - RNA, 1410 nt, Artificial Sequence
  neuraminidase__InfluenzaA__ACN33082
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacuggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47132 - RNA, 1413 nt, Artificial Sequence; identical to SEQ ID NO: 46573
  neuraminidase__InfluenzaA__ACN33093

SEQ ID NO: 47133 - RNA, 1413 nt, Artificial Sequence
  neuraminidase__InfluenzaA__ACN33104
augaauccaaaucaaaaaauaauaaccauuggaucaaucaguauagcaaucgggauaauuagucuaaugcugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccgucuccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47134 - RNA, 1410 nt, Artificial Sequence
  neuraminidase__InfluenzaA__ACN33115
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacuggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucagggcuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47135 - RNA, 1413 nt, Artificial Sequence
  neuraminidase__InfluenzaA__ACN33126
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaguucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcccuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacgggguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47136 - RNA, 1413 nt, Artificial Sequence
  neuraminidase__InfluenzaA__ACN33148
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcugugcuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguauuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47137 - RNA, 1410 nt, Artificial Sequence
  neuraminidase__InfluenzaA__ACN33159
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaaaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47138 - RNA, 1410 nt, Artificial Sequence
  neuraminidase__InfluenzaA__ACN33170
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47139 - RNA, 1410 nt, Artificial Sequence
  neuraminidase__InfluenzaA__ACN33181
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucggaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggaguaaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuacguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47140 - RNA, 1410 nt, Artificial Sequence
  neuraminidase__InfluenzaA__ACN33203
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacuggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47141 - RNA, 1410 nt, Artificial Sequence
  neuraminidase__InfluenzaA__ACN33214
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagacaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47142 - RNA, 1413 nt, Artificial Sequence
  neuraminidase__InfluenzaA__ACN42984
augaauccaaaucaaaaaauaauaaccauuggaucaaucaguauagcaaucggaauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaagggagauguuuuugucauaagagaaccuuucauaucauguucucauuuggaaugcaggaccuuuuuucugacccaaggugcucuauuaaaugacaaacauucaaauggaaccguuaaggacagaaguccuuauagagccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaaacgaauauugagaacacaagagucugaaugugucugugugaacgggucuuguuucaccauaaugaccgauggcccgaguaauggggccgccucguacaaaaucuucaagauugaaaagggaaagguuacuaaaucaauagaguuaaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacggaguuaagggguuuucauacaaauaugguaaugguguuuggauaggaagaacuaaaaguaacaggcuuagaaagggguuugagaugauuugggauccuaauggauggacaaauaccgacagugauuucucagugaaacaggauguuguggcaauaacugauuggucaggguacaguggaaguuucguucaacauccugaguuaacaggauuggacuguauaagaccuugcuucuggguugaauuagucagaggacugccuagagaaaauacaacaaucuggacuagugggagcagcauuucuuuuuguggcguugauagugauacugcaaacuggucuuggccagacggugcugaguugccguucaccauugacaaauag

SEQ ID NO: 47143 - RNA, 1413 nt, Artificial Sequence; identical to SEQ ID NO: 46711
  neuraminidase__InfluenzaA__ACN42995

SEQ ID NO: 47144 - RNA, 1410 nt, Artificial Sequence
  neuraminidase__InfluenzaA__ACN43006
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccgagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47145 - RNA, 1410 nt, Artificial Sequence; identical to SEQ ID NO: 47140
  neuraminidase__InfluenzaA__ACN43017

SEQ ID NO: 47146 - RNA, 1410 nt, Artificial Sequence; identical to SEQ ID NO: 47103
  neuraminidase__InfluenzaA__ACN43028

SEQ ID NO: 47147 - RNA, 1410 nt, Artificial Sequence
  neuraminidase__InfluenzaA__ACN43039
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggagaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47148 - RNA, 1410 nt, Artificial Sequence; identical to SEQ ID NO: 47018
  neuraminidase__InfluenzaA__ACN43050

SEQ ID NO: 47149 - RNA, 1410 nt, Artificial Sequence; identical to SEQ ID NO: 47103
  neuraminidase__InfluenzaA__ACN43061

SEQ ID NO: 47150 - RNA, 1410 nt, Artificial Sequence
  neuraminidase__InfluenzaA__ACN43072
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguguuguuguguuuuguggcaccucagguacauauggaacaggcucauggccugauggggcggacaucaaucucaugccuauauaa

SEQ ID NO: 47151 - RNA, 1410 nt, Artificial Sequence
  neuraminidase__InfluenzaA__ACN43083
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaacgaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47152 - RNA, 1410 nt, Artificial Sequence
  neuraminidase__InfluenzaA__ACN50231
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaccugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47153 - RNA, 1410 nt, Artificial Sequence
  neuraminidase__InfluenzaA__ACN50233
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaauaaccaagugaugcugugugaaccaacaauaauagaaagaaacauaacagagauaguguaucugaccaacaccacaauagagaaggaaauaugccccaaauuagcagaguacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguauugacugaugggagugcuucaggaaaagcugauacuaaaauacuauucauugaggaggggaaaaucguucauacuagcaaauugucaggaagugcucagcaugucgaggagugcuccugcuauccucgauauccuggugucagaugugucugcagagacaacuggaaaggcuccaauaggcccauuguagauauaaacauaaaggauuauagcauuguuucuaguuauguuugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucuccguugaaggcaaaagcugcaucaaucggugcuuuuauguggaguugauaaggggaagaaaagaggaaacugaaguccuguggaccucaaacaguauuguuguguuuuguggcaccucagguacauauggaacaggcucauggccugauggggcggacaucaaucucaugccuauauaa

SEQ ID NO: 47154 - RNA, 1410 nt, Artificial Sequence
  neuraminidase__InfluenzaA__ACN50245
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaaguggugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugacaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47155 - RNA, 1413 nt, Artificial Sequence
  neuraminidase__InfluenzaA__ACN72609
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcugugcuaaaauacaacggaauaauaacuggaaccauaaaaaguuggaaaaagcaaauauuaagaacacaagagucugaauguguuuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuauaaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47156 - RNA, 1410 nt, Artificial Sequence
  neuraminidase__InfluenzaA__ACN72621
augaauccaaaucagaagauaauaaucauuagcucaaucuguaugacaaauggaauugcuagcuugauauuacaaauugggaacauaaucucaauauggauuagccauucaauucaaacugggaaccaaaaccagaccgaaacaugcaaucaaagcguuauuauuuacgaaaacaacacuuggguaaaucagacauaugucaacaucaguaacaacaauuuuguugcugaacagacaguaguuccagugaaauuagugggcaguucuccucucugcccuguuagugggugggcuauauacaguaaagauaacaguguaagaaucgguuccaaaggggauguguuugucauaagagagccauucaucucaugcucccacuuggaauguagaaccuucuucuuaacucaaggggcccugcugaaugacaaacacuccaauggaaccguuaaagacagaagccccuaucgaacccugaugagcuguccuauuggugaaguccccucuccauacaacucaagauuugagucaguugcuuggucagcaagugcuugccaugauggcuccaguugguugacaauuggaauuucuggcccggacaauggggcaguggcugugcugaaauacaaugacauaauaacagacacuaucaagaguuggaaaaacaacauauugagaacacaagagucugaaugugcaugcuugaauggcucuugcuuuacuguaaugaccgauggaccaaguaaugggcaggccucauacaaaaucuucaaaauagaaaaggggaaaguagucaaaucagucgaguugaaugcuccuaauuaucacuaugaagaguguuccuguuauccugauucuggugaaaucauaugugugugcagggacaauuggcauggcucgaaucgaccaugggugucuuucaaucagaaucuggaauaucaaauaggauacauaugcagugggguucucggagacaauccgcgcccuaaugauagaacaggcaauugugguccaguaucaucucauggagcaaaugggguaaaaggguuuucguuuaaauacggcgaugguauuuggauagggagaacuaaaagcacuaguucaaggagcgguuuugagaugauuugggacccaaacggauggacuggaacagacaauaauuucucaguaaagcaagauauuguaggaauaacugacuggacaggauacagcgggaguuuuguccagcauccagaauuaaccggauuggauuguauuagaccuugcuucuggguugaacuaaucagagggagacccaaagagaacacaaucuggacuagcgggagcagcauauccuuuugugguguaaauagugacacuguggguuggucuuggccagacggugcugaguugccauuuaccauugacaaguaa

SEQ ID NO: 47157 - RNA, 1410 nt, Artificial Sequence; identical to SEQ ID NO: 47018
  neuraminidase__InfluenzaA__ACN76503

SEQ ID NO: 47158 - RNA, 1410 nt, Artificial Sequence
  neuraminidase__InfluenzaA__ACO36345
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcagugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugacgggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47159 - RNA, 1410 nt, Artificial Sequence; identical to SEQ ID NO: 45484
  neuraminidase__InfluenzaA__ACO36356

SEQ ID NO: 47160 - RNA, 1410 nt, Artificial Sequence
  neuraminidase__InfluenzaA__ACO36367
augaauccaaaucaaaagauaauaacgauuggcucuguuucucucaucaucuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauuuggaacaggcucauggccugauggggcggacaucaaucucaugccuauauaa

SEQ ID NO: 47161 - RNA, 1413 nt, Artificial Sequence
  neuraminidase__InfluenzaA__ACO36400
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcugugcuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaagaaccaaaaguaacagacuuagaaagggguuugagaugauuugggauccuaauggauggacaaauaccgauagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuuccuuuuguggcguuaauagugauacugcaaacuggucuuggccagacggugcugaguugccguucaccauugacaaguag

SEQ ID NO: 47162 - RNA, 1410 nt, Artificial Sequence
  neuraminidase__InfluenzaA__ACO36411
augaauccaaaucaaaagauaauaacgauuggcucuguuucucucaccauuuccacaauaggcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47163 - RNA, 1410 nt, Artificial Sequence
  neuraminidase__InfluenzaA__ACO36422
augaauccaaaucaaaagauaauaacgauuggcucuguuucucucaucauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47164 - RNA, 1410 nt, Artificial Sequence
  neuraminidase__InfluenzaA__ACO36433
augaauccaaaucaaaagauaauaacgauuggcucuguuucucucaucauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47165 - RNA, 1410 nt, Artificial Sequence
  neuraminidase__InfluenzaA__ACO36444
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaaaaugccccaaacuagcagaauacagaaauuggucaaagccgcaauguaacauuacaggauuugcaccuuuuucuaaggacaauucgauucgacuuuccgcugguggggacaucugggugacaagagaaccuuaugugucaugcgauccugacaaguguuaucaauuugcccuugggcagggaacaacacuaaacaacgggcauucaaauaacacaguacaugauaggaccccuuaccggacccuauugaugaaugaauuggguguuccauuucauuugggaaccaggcaagugugcauagcaugguccagcucaaguugucacgauggaaaagcauggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucagaaaaagcugauacuaaaauacuauucauugaggaggggaaaaucguucauauuagcacauugucaggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggccuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 47166 - RNA, 1410 nt, Artificial Sequence
  neuraminidase__InfluenzaA__ACO36466
augaauccaaaucaaaagauaauaacgauuggcucuguuucucucaccauuuccacaauaugcuucuucaugcaaauugcuauucugauaacuacuguaacauugcauuucaagcaauaugaauucaacucccccccaaacaaccaagugaugcugugugaaccaacaauaauagaaagaaacauaacagagauagcguaucugaccaacaccaccauagagaaggaaauaugccccaaacuagcagaauauagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggauccaauaggcccaucguagauauaaacauaaaggauuauagcauuguuuccagcuaugugugcucaggacuuguuggagacacacccagaaaaaacgacagcuccagcaguagccauugcuuggauccaaacaaugaagaagguggucauggagugaaaggcugggccuuugaugaugggaaugacguguggaugggaagaacgaucagcgagaaguuacgcucaggauaugaaaccuucaaagucauugaaggcugguccaauccuaacuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47167 - RNA, 1410 nt, Artificial Sequence
  neuraminidase__InfluenzaA__ACO36477
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaauauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucgggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggcuuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 47168 - RNA, 1410 nt, Artificial Sequence
  neuraminidase__InfluenzaA__ACO36499
augaauccaaaucaaaagauaauaacgauuggcucuguuucucucaccauuuccacaauaugcuucuucaugcaaauugccauucugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuggguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccagcuaugugugcucaggacuuguuggagacacacccagaaaaaacgacagcuccagcaguagccauugcuuggauccaaacaaugaagaagguggucauggagugaaaggcugggccuuugaugauggaaaugacguauggaugggaagaacgaucagcgagaaguuacgcucaggauaugaaaccuucaaagucauugaaggcugguccaacccuaacuccaaauugcagauaaauaggcaagucauaguugacagagguaauagguccgguuauucugguauuuucucuguugaaggcaaaagcugcaucaaucgaugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47169 - RNA, 1410 nt, Artificial Sequence
  neuraminidase__InfluenzaA__ACO36510
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47170 - RNA, 1410 nt, Artificial Sequence
  neuraminidase__InfluenzaA__ACO36543
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauuacagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47171 - RNA, 1410 nt, Artificial Sequence
  neuraminidase__InfluenzaA__ACO36554
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaagggggagaaaagaggaaacugaagucuuguggaccucaaacaguauuguuguguuuuguggcaccucagguacauauggaacaggcucauggccugauggggcggacaucaaucucaugccuauauaa

SEQ ID NO: 47172 - RNA, 1410 nt, Artificial Sequence
  neuraminidase__InfluenzaA__ACO36565
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47173 - RNA, 1410 nt, Artificial Sequence
  neuraminidase__InfluenzaA__ACO36576
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggagaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguuggcagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47174 - RNA, 1410 nt, Artificial Sequence
  neuraminidase__InfluenzaA__ACO36587
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaggucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47175 - RNA, 1410 nt, Artificial Sequence
  neuraminidase__InfluenzaA__ACO36609
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcgccuuuuucuaaggacaauucgauuaggcuuuccgcugguggggacaucugggugacaagagaaccuuaugugucaugcgauccugacaaguguuaucaauuugcccuaggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 47176 - RNA, 1410 nt, Artificial Sequence
  neuraminidase__InfluenzaA__ACO36620
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagguaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47177 - RNA, 1410 nt, Artificial Sequence
  neuraminidase__InfluenzaA__ACO36631
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaagguaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47178 - RNA, 1410 nt, Artificial Sequence; identical to SEQ ID NO: 45232
  neuraminidase__InfluenzaA__ACO36653

SEQ ID NO: 47179 - RNA, 1410 nt, Artificial Sequence
  neuraminidase__InfluenzaA__ACO36675
augaauccaaaucaaaagauaauaacgauuggcucuguuucucucaccauuuccacaauaugccucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47180 - RNA, 1410 nt, Artificial Sequence
  neuraminidase__InfluenzaA__ACO36686
augaauccaaaucaaaagauaauaacgauuggcucuguuucucucaccauuuccacaauaugcuucuucaugcaaauugccaucuugauaacuacugugacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgaucaugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47181 - RNA, 1410 nt, Artificial Sequence
  neuraminidase__InfluenzaA__ACO37125
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaugcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47182 - RNA, 1410 nt, Artificial Sequence
  neuraminidase__InfluenzaA__ACO94511
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagcaauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaagucaaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47183 - RNA, 1410 nt, Artificial Sequence
  neuraminidase__InfluenzaA__ACO94512
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47184 - RNA, 1410 nt, Artificial Sequence
  neuraminidase__InfluenzaA__ACO94513
augaauccaaaucaaaagauaauaacgauuggcucuguuucucucaccauuuccacaauaugcuucuucaugcaaauugccauuuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauaccagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47185 - RNA, 1410 nt, Artificial Sequence
  neuraminidase__InfluenzaA__ACO94675
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaagaaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47186 - RNA, 1410 nt, Artificial Sequence
  neuraminidase__InfluenzaA__ACO94686
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaacaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggaaaucaaucucaugccuauauaa

SEQ ID NO: 47187 - RNA, 1410 nt, Artificial Sequence
  neuraminidase__InfluenzaA__ACO94697
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaauggaaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagggacauauggaacaggcucauggccugauggggcggacaucaaucucaugccuauauaa

SEQ ID NO: 47188 - RNA, 1413 nt, Artificial Sequence
  neuraminidase__InfluenzaA__ACO94708
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacgggguaaaaggguuuucauacaaauaugauaaugguguuuggauaggaaggaccaaaaguaacagacuuagaaagggguuugaaaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagggaaaauacaacaaucuggacuagugggagcagcauuucuuuuuguggcguuaauagugauacugcaaacuggucuuggccagacggugcugaguugccguucaccauugacaaguag

SEQ ID NO: 47189 - RNA, 1410 nt, Artificial Sequence
  neuraminidase__InfluenzaA__ACO94719
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucugcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguggccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggaaaucaaucucaugccuauauaa

SEQ ID NO: 47190 - RNA, 1410 nt, Artificial Sequence
  neuraminidase__InfluenzaA__ACO94741
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaagcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47191 - RNA, 1410 nt, Artificial Sequence
  neuraminidase__InfluenzaA__ACO94763
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggagauaugccccaaacuagcagaauacagaaauuggucaaagccgcaaugugacauuacaggauuugcaccuuuuucuaaggacaauucaauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47192 - RNA, 1410 nt, Artificial Sequence
  neuraminidase__InfluenzaA__ACO94774
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagaaauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauggcaugguccagcucaaguugucacgauggaagagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47193 - RNA, 1410 nt, Artificial Sequence
  neuraminidase__InfluenzaA__ACO94785
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcuguguaaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47194 - RNA, 1410 nt, Artificial Sequence; identical to SEQ ID NO: 47103
  neuraminidase__InfluenzaA__ACO94796

SEQ ID NO: 47195 - RNA, 1413 nt, Artificial Sequence
  neuraminidase__InfluenzaA__ACO94807
augaacccaaaucaaaaaauaauaaccauuggaucaaucaguauagcaaucggaauaauuagucuaauauugcaaauaggaaauauuauuucaauaugggcuagucacucaauccaaacuggaagucaaaaccacacuggaauaugcaaccaaagaaucauuacauaugaaaacagcaccugggugaauaacacauauguuaauauuaacaacaccaauguuguugcugaaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccguccccauacaauucaagguucgaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauuaagaacacaagagucugaaugugucuguaugaacgggucauguuucaccauaaugaccgauggcccgaguaaugggaccgccucguacaaaauuuucaagaucgaaaaggggaagguuaccaaaacaauagaguugaaugcacccaauuuucauuaugaggaauguuccuguuacccagacacuggcacagugauguguguaugcagagacaacuggcaugguucaaaucgaccuugggugucuuuuaaucaaaacuuggauuaucaaauaggauacaucugcaguggaguguucggugacaauccgcgucccaaagauggggagggcagcugcaauccagugacuguugauggagcagacggaguaaaaggguuuucauacaaauaugguaaugguguuuggauaggaaggaccaaaaguaacagacuuagaaagggguuugagaugauuugggauccuaauggauggacaaauaccgacagugauuucucaguuaaacaggauguuguagcaauaacugauuggucaggguacagcggaaguuuuguucaacauccugaguuaacaggauuggacuguauaagaccuugcuucuggguugaguuagucagagggcugccuagggaaaauacaacaaucuggacuagugggagcagcauuucuuuuuguggcguuaauagugguacugcaaacuggucuuggccagacggugcugaguugccguucaccauugacaaguag

SEQ ID NO: 47196 - RNA, 1410 nt, Artificial Sequence; identical to SEQ ID NO: 46923
  neuraminidase__InfluenzaA__ACO94818

SEQ ID NO: 47197 - RNA, 1365 nt, Artificial Sequence; identical to SEQ ID NO: 46223
  neuraminidase__InfluenzaA__ACO94829

SEQ ID NO: 47198 - RNA, 1365 nt, Artificial Sequence
  neuraminidase__InfluenzaA__ACO94840
augaauccaaaucagaaaauaauaaccauuggaucaaucugucugguagucggacuaauuagccuaauauuacaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaagaaaaaacaaucuggacuagugcgagcagcauuucuuuuuguggcgugaauagugauacuguagauuggucuuggccagacggugcugaguugccauucagcauugacaaguag

SEQ ID NO: 47199 - RNA, 1410 nt, Artificial Sequence
  neuraminidase__InfluenzaA__ACO94851
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacauaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47200 - RNA, 1413 nt, Artificial Sequence
  neuraminidase__InfluenzaA__ACO94873
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaucaaagaaucaucacauaugaaaacagcaccugggugaaucacacauauguuaauauuaacaacaccaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccuuccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugcccagagaaaauacaacaaucuggacuagugggagcagcauuucuuuuuguggcguuaauagugauacugcaaacugguccuggccagacggugcugaguugccguucaccauugacaaguag

SEQ ID NO: 47201 - RNA, 1410 nt, Artificial Sequence
  neuraminidase__InfluenzaA__ACO94884
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaaugugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucgggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggcuuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 47202 - RNA, 1410 nt, Artificial Sequence
  neuraminidase__InfluenzaA__ACO94906
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagaaaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47203 - RNA, 1410 nt, Artificial Sequence
  neuraminidase__InfluenzaA__ACO94917
augaauccaaaucaaaagauaauaacaauuggcucuguuucucucaccauugccacaauaugcuuccuuaugcaaauugccauccugguaacuacuguaacauugcauuucaagcagcaugaaugcaacucccccccaaacaaccaaguaaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuugggcagggaacaacacuaaacaacgggcauucaaaugacacaguacaugauaggaccccuuaccggacccuauugaugaaugaauuggguguuccauuucauuugggaaccaggcaagugugcauagcaugguccagcucaaguugucacgauggaaaagcguggcugcauguuuguguaacuggggaugauaaaaaugcaacugcuagcuucauuuacaaugggaggcuuguagauaguauugguucaugguccaaaaaaauacucagaacccaggagucggaaugcguuuguaucaauggaacuuguacaguaguaaugacugaugggagcgcuucaggaaaagcugauacuaaaauacuauucauugaggaggggaaaaucguucauauuagcacauugucgggaagugcucagcaugucgaggagugcuccuguuauccucgauauccuggugucagaugugucugcagagacaacuggaaaggcuccaauaggcccauuguagauauaaauguaaaggauuauagcauuguuuccaguuaugugugcucaggacuuguuggagacacacccagaaaaaacgacagcuucagcaguagccauugccuagauccuaacaaugaggaagguggucauggagugaaaggcugggcuuuugaugauggaaaugacguguggaugggaagaacgaucagcgagaaguuacgcucagguuaugaaaccuucaaagucaucgaaggcugguccaaaccuaacuccaaauuacagauaaauaggcaaguuauaguugaaagagguaacagguccgguuauucugguauuuucuccguugaaggcaaaagcugcaucaaucggugcuuuuauguggaguugauaaggggaaggaaagaggaaacugaagucugguggaccucaaacaguauuguuguguuuuguggcaccucagguacauauggaacaggcucauggccugauggggcggauaucaaucucaugccuauauaa

SEQ ID NO: 47204 - RNA, 1410 nt, Artificial Sequence
  neuraminidase__InfluenzaA__ACO94928
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuucagcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauaccaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagucauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47205 - RNA, 1410 nt, Artificial Sequence; identical to SEQ ID NO: 47203
  neuraminidase__InfluenzaA__ACO94939

SEQ ID NO: 47206 - RNA, 1410 nt, Artificial Sequence
  neuraminidase__InfluenzaA__ACO94950
augaauccaaaucaaaagauaauaacgauuggcucuguuucucucaccauuuccacaauaugcuuccucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaagagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47207 - RNA, 1410 nt, Artificial Sequence
  neuraminidase__InfluenzaA__ACO94961
augaauccaaaucaaaagauaauaacgauuggcucuguuucucucaccauuuccacaauaugcuucuucaugcaaauugccaucuugauaacuacuguaacauugcauuucaaacaauaugaauucaacucccccccaaacaaccaagugaugcugugugaaccaacaauaauagaaagaaacauaacagagauaguguaucugaccaacaccaccauagagaaggaauuaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggauggggagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47208 - RNA, 1410 nt, Artificial Sequence
  neuraminidase__InfluenzaA__ACO94972
augaauccaaaucaaaagauaauaacgauuggcucuguuucucucaccauuuccacaauaugcuucuucaugcaaauugcuauucugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggauccaauaggcccaucguagauauaaacauaaaggauuauagcauuguuuccagcuaugugugcucaggacuuguuggagacacacccagaaaaaacgacagcuccagcaguagccauugcuuggauccaaacaaugaagaagguggucauggagugaaaggcugggccuuugaugaugggaaugacguguggaugggaagaacgaucagcgagaaguuacgcucaggauaugaaaccuucaaagucauugaaggcugguccaauccuaacuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47209 - RNA, 1410 nt, Artificial Sequence
  neuraminidase__InfluenzaA__ACO95156
augaauccaaaucaaaagauaauaacgauuggcucuguuucucucaccauuuccacaauaugcuucuucaugcaaauugccauucugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaacaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuggguguuccauuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaaaaaauccucaggacccaggagucagaaugcguuuguaucaauggaacuuguaccguaguaaugacugaugggagugcuucaggaaaagcugauacuaaaauacuauucauugaggaggggaaaaucguucauacuagcacauugucuggaagugcucagcaugucgaggagugcuccuguuauccucgauauccuggugucagaugugucugcagagacaacuggaaaggcuccaauaggcccaucguagauauaaacauaaaggauuauagcauuguuuccagcuaugugugcucaggacuuguuggagacacacccagaaaaaacgacagcuccagcaguagccauugcuuggauccaaacaaugaagaagguggucauggagugaagggcugggccuuugaugauggaaaugacguauggaugggaagaacgaucagcgagaaguuacgcucaggauaugaaaccuucaaagucauugaaggcugguccaauccuaacuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47210 - RNA, 1410 nt, Artificial Sequence
  neuraminidase__InfluenzaA__ACO95174
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauaccaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaauccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47211 - RNA, 1410 nt, Artificial Sequence; identical to SEQ ID NO: 47172
  neuraminidase__InfluenzaA__ACO95185

SEQ ID NO: 47212 - RNA, 1410 nt, Artificial Sequence
  neuraminidase__InfluenzaA__ACO95196
augaauccaaaucaaaagauaauaacgauuggcucuguuucucucaccauuuccacaauaugcuucuucaugcaaauugccauucugauaacuacuguaacauugcauuucaagcaauaugaauucaacucccccccaaacaaccaagugaugcugugugaaccaacaauaauagaaagaaacauaacagagauaguguaucugaccaacaccaccauagaaaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacgacacuaaacaacgugcauucaaaugacacaauacaugauaggaccccuuaucggacccuauugaugaaugaauuggguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccagcuaugugugcucaggacuuguuggagacacacccagaaaaaacgacagcuccagcaguagccauugcuuggauccaaacaaugaagaagguggucauggagugaaaggcugggccuuugaugauggaaaugacguauggaugggaagaacgaucagcgagaaguuacgcucaggauaugaaaccuucaaagucauugaaggcugguccaauccuaacuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47213 - RNA, 1410 nt, Artificial Sequence
  neuraminidase__InfluenzaA__ACO95207
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcagcagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauaugggacaggcucauggccugauggggcggacaucaaucucaugccuauauaa

SEQ ID NO: 47214 - RNA, 1410 nt, Artificial Sequence
  neuraminidase__InfluenzaA__ACO95218
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaagaggaagaaaagaggaaaccgaagucuuguggaccucaaacaguauuguuguguuuuguggcaccucagguacauauggaacaggcucauggccugauggggcggacaucaaucucaugccuauauaa

SEQ ID NO: 47215 - RNA, 1410 nt, Artificial Sequence
  neuraminidase__InfluenzaA__ACO95229
augaauccaaaucaaaagauaauaacgauuggcucuguuucucucaccauuuccacaauaugcuuuuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaaugugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaccaauuugcucuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucauucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaaccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47216 - RNA, 1410 nt, Artificial Sequence
  neuraminidase__InfluenzaA__ACO95240
augaauccaaaucaaaagauaauaacgauuggcucuguuucucucaccauuuccacaauaugcuucuucaugcaaauugccaucuugauaacuacuguaacauugcauuucaagcaauaugaguucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47217 - RNA, 1410 nt, Artificial Sequence
  neuraminidase__InfluenzaA__ACO95262
augaauccaaaucaaaagauaauaacgauuggcucuguuucucucacuauugccacaauaugcuuccuuaugcaaauugccauccugguaacuacuguaacauugcauuucaagcaauaugaaugcagcucucccccaaacaaccaaguaaugcugugugaaccaacaauaauagaaagaaacauaacagagauaguguaucugaccaacaccaccauagagaaggaaauaugccccaaacuagcagaauacagaaauuggucaaagccacaauguaaaauuacaggauuugcaccuuuuucuaaggacaauucaauucggcuuuccgcugguggggacauuugggugacaagggaaccuuaugugucgugcgauccugacaaguguuaucaauuugcccuuggacagggaacaacacuaaacaacaggcauucaaaugacacaguacaugauaggaccccuuaucgaacccuauugaugaaugaguuggguguuccauuucauuugggaaccaagcaagugugcauagcaugguccagcucaaguugucacgauggaaaagcauggcugcauguuuguguaacugggcaugaugaaaaugcaacugcuagcuucauuuacgaugggaggcuuguagauaguauugguucaugguccaaaaaaauccucaggacccaggagucggaaugcguuuguaucaauggaacuuguacaguaguaaugacugaugggagugcuucaggaagagcugauacuaaaauacuauucauugaggaggggaaaaucguucauaucagcccacugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagucauugccugaauccuaacaaugaggaagggggucauggagugaaaggcugggccuuugaugauggaaaugacguguggaugggaagaacgaucagcgagaaguuccgcucagguuaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucugguggaccucaaacaguauuguuguguuuuguggcaccucagguacauauggaacaggcucauggccugauggggcggacaucaaucucaugccuauauaa

SEQ ID NO: 47218 - RNA, 1410 nt, Artificial Sequence; identical to SEQ ID NO: 47015
  neuraminidase__InfluenzaA__ACO95273

SEQ ID NO: 47219 - RNA, 1410 nt, Artificial Sequence
  neuraminidase__InfluenzaA__ACO95306
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47220 - RNA, 1413 nt, Artificial Sequence
  neuraminidase__InfluenzaA__ACO95385
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgagugauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggauacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47221 - RNA, 1413 nt, Artificial Sequence; identical to SEQ ID NO: 47200
  neuraminidase__InfluenzaA__ACO95407

SEQ ID NO: 47222 - RNA, 1413 nt, Artificial Sequence; identical to SEQ ID NO: 47200
  neuraminidase__InfluenzaA__ACO95418

SEQ ID NO: 47223 - RNA, 1410 nt, Artificial Sequence; identical to SEQ ID NO: 47203
  neuraminidase__InfluenzaA__ACO95429

SEQ ID NO: 47224 - RNA, 1410 nt, Artificial Sequence
  neuraminidase__InfluenzaA__ACO95440
augaauccaaaucaaaagauaauaacgauuggcucuguuucucucaccauuuccacaauaugcuucuucaugcaaauugccaucuugauaacuacuguaacauugcacuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgccgguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagagugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgguauccuggugucagaugugucugcagagacaacuggaaaggcuccaauaggcccaucguagauauaaacauaaaggauuauagcauuguuuccaguuaugugugcucaggacuuguuggagacacacccagaaaaaacgauagcuccaguaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47225 - RNA, 1410 nt, Artificial Sequence
  neuraminidase__InfluenzaA__ACO95462
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugcuuauauaa

SEQ ID NO: 47226 - RNA, 1410 nt, Artificial Sequence; identical to SEQ ID NO: 45232
  neuraminidase__InfluenzaA__ACO95484

SEQ ID NO: 47227 - RNA, 1410 nt, Artificial Sequence; identical to SEQ ID NO: 45232
  neuraminidase__InfluenzaA__ACO95495

SEQ ID NO: 47228 - RNA, 1410 nt, Artificial Sequence; identical to SEQ ID NO: 45232
  neuraminidase__InfluenzaA__ACO95506

SEQ ID NO: 47229 - RNA, 1410 nt, Artificial Sequence
  neuraminidase__InfluenzaA__ACO95517
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcuuaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggagcggacaucaaucucaugccuauauaa

SEQ ID NO: 47230 - RNA, 1410 nt, Artificial Sequence
  neuraminidase__InfluenzaA__ACO95539
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaguguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcuaauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaagaggaagaaaagaggaaacugaaguccuguggaccucaaacaguauuguuguguuuuguggcaccucagguacauauggaacaggcucauggccugauggggcggacaucaaucucaugccuauauaa

SEQ ID NO: 47231 - RNA, 1413 nt, Artificial Sequence
  neuraminidase__InfluenzaA__ACP20223
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggauaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaguaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47232 - RNA, 1410 nt, Artificial Sequence
  neuraminidase__InfluenzaA__ACP41952
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47233 - RNA, 1410 nt, Artificial Sequence; identical to SEQ ID NO: 47232
  neuraminidase__InfluenzaA__ACP44158

SEQ ID NO: 47234 - RNA, 1413 nt, Artificial Sequence
  neuraminidase__InfluenzaA__ACP44195
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgagugauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggauacagcggaaguuucguccaacauccugaguuaacaggauugaacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47235 - RNA, 1413 nt, Artificial Sequence
  neuraminidase__InfluenzaA__ACP44217
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagccccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacgaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47236 - RNA, 1413 nt, Artificial Sequence
  neuraminidase__InfluenzaA__ACP44228
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacgaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47237 - RNA, 1410 nt, Artificial Sequence
  neuraminidase__InfluenzaA__ACP44239
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuugggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugacgauggaaaugacguguggaugggaagaacgaucagcgagaaguugcgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47238 - RNA, 1410 nt, Artificial Sequence
  neuraminidase__InfluenzaA__ACP44250
augaauccaaaucaaaagauaauaacgauuggcucuguuucucucaccauuuccacaauaugcuucuucaugcaaauugccaucuugaugacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauuacagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47239 - RNA, 1410 nt, Artificial Sequence
  neuraminidase__InfluenzaA__ACP44261
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacaugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47240 - RNA, 1410 nt, Artificial Sequence
  neuraminidase__InfluenzaA__ACP44272
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaauaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47241 - RNA, 1410 nt, Artificial Sequence
  neuraminidase__InfluenzaA__ACQ55360
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47242 - RNA, 1410 nt, Artificial Sequence
  neuraminidase__InfluenzaA__ACQ63236
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47243 - RNA, 1410 nt, Artificial Sequence; identical to SEQ ID NO: 47242
  neuraminidase__InfluenzaA__ACQ63242

SEQ ID NO: 47244 - RNA, 1410 nt, Artificial Sequence; identical to SEQ ID NO: 47242
  neuraminidase__InfluenzaA__ACQ63253

SEQ ID NO: 47245 - RNA, 1410 nt, Artificial Sequence; identical to SEQ ID NO: 47242
  neuraminidase__InfluenzaA__ACQ63262

SEQ ID NO: 47246 - RNA, 1410 nt, Artificial Sequence
  neuraminidase__InfluenzaA__ACQ65694
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagacauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47247 - RNA, 1410 nt, Artificial Sequence
  neuraminidase__InfluenzaA__ACQ65705
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47248 - RNA, 1410 nt, Artificial Sequence
  neuraminidase__InfluenzaA__ACQ65716
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguugaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47249 - RNA, 1410 nt, Artificial Sequence
  neuraminidase__InfluenzaA__ACQ65727
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaaggacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47250 - RNA, 1410 nt, Artificial Sequence; identical to SEQ ID NO: 47103
  neuraminidase__InfluenzaA__ACQ65739

SEQ ID NO: 47251 - RNA, 1410 nt, Artificial Sequence
  neuraminidase__InfluenzaA__ACQ65750
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacguaauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47252 - RNA, 1413 nt, Artificial Sequence
  neuraminidase__InfluenzaA__ACQ65761
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaucaaagaaucaucacauaugaaaacagcaccugggugaaucacacauauguuaauauuaacaacaccaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccuuccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauacagacagugauuucucagugaaacaggauguuguagcaauaacugauuggucaggguacaguggaaguuucguccaacauccugaguuaacaggauuggacuguauaagaccuugcuucuggguugaguuagucagagggcugcccagagaaaauacaacaaucuggacuagugggagcagcauuucuuuuuguggcguuaauagugauacugcaaacugguccuggccagacggugcugaguugccguucaccauugacaaguag

SEQ ID NO: 47253 - RNA, 1410 nt, Artificial Sequence
  neuraminidase__InfluenzaA__ACQ73394
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47254 - RNA, 1410 nt, Artificial Sequence; identical to SEQ ID NO: 47241
  neuraminidase__InfluenzaA__ACQ73395

SEQ ID NO: 47255 - RNA, 1410 nt, Artificial Sequence; identical to SEQ ID NO: 47242
  neuraminidase__InfluenzaA__ACQ73396

SEQ ID NO: 47256 - RNA, 1410 nt, Artificial Sequence; identical to SEQ ID NO: 47242
  neuraminidase__InfluenzaA__ACQ76291

SEQ ID NO: 47257 - RNA, 1410 nt, Artificial Sequence
  neuraminidase__InfluenzaA__ACQ76298
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguaguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccauaaugaccgauggacccaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47258 - RNA, 1410 nt, Artificial Sequence; identical to SEQ ID NO: 47242
  neuraminidase__InfluenzaA__ACQ76308

SEQ ID NO: 47259 - RNA, 1410 nt, Artificial Sequence; identical to SEQ ID NO: 47242
  neuraminidase__InfluenzaA__ACQ76316

SEQ ID NO: 47260 - RNA, 1410 nt, Artificial Sequence; identical to SEQ ID NO: 47241
  neuraminidase__InfluenzaA__ACQ76322

SEQ ID NO: 47261 - RNA, 1410 nt, Artificial Sequence; identical to SEQ ID NO: 47241
  neuraminidase__InfluenzaA__ACQ76328

SEQ ID NO: 47262 - RNA, 1410 nt, Artificial Sequence
  neuraminidase__InfluenzaA__ACQ76335
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguaguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47263 - RNA, 1410 nt, Artificial Sequence
  neuraminidase__InfluenzaA__ACQ76342
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47264 - RNA, 1410 nt, Artificial Sequence
  neuraminidase__InfluenzaA__ACQ76351
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaacaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47265 - RNA, 1410 nt, Artificial Sequence
  neuraminidase__InfluenzaA__ACQ76359
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47266 - RNA, 1410 nt, Artificial Sequence; identical to SEQ ID NO: 47242
  neuraminidase__InfluenzaA__ACQ76364

SEQ ID NO: 47267 - RNA, 1410 nt, Artificial Sequence; identical to SEQ ID NO: 47242
  neuraminidase__InfluenzaA__ACQ76367

SEQ ID NO: 47268 - RNA, 1410 nt, Artificial Sequence
  neuraminidase__InfluenzaA__ACQ76379
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuauaaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggagccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47269 - RNA, 1410 nt, Artificial Sequence; identical to SEQ ID NO: 47242
  neuraminidase__InfluenzaA__ACQ76385

SEQ ID NO: 47270 - RNA, 1410 nt, Artificial Sequence; identical to SEQ ID NO: 47242
  neuraminidase__InfluenzaA__ACQ76388

SEQ ID NO: 47271 - RNA, 1410 nt, Artificial Sequence; identical to SEQ ID NO: 47242
  neuraminidase__InfluenzaA__ACQ76403

SEQ ID NO: 47272 - RNA, 1410 nt, Artificial Sequence
  neuraminidase__InfluenzaA__ACQ76407
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47273 - RNA, 1410 nt, Artificial Sequence
  neuraminidase__InfluenzaA__ACQ77603
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugauggggcggacaucaaucucaugccuauauaa

SEQ ID NO: 47274 - RNA, 1410 nt, Artificial Sequence
  neuraminidase__InfluenzaA__ACQ83309
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguucucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47275 - RNA, 1410 nt, Artificial Sequence
  neuraminidase__InfluenzaA__ACQ84460
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47276 - RNA, 1410 nt, Artificial Sequence
  neuraminidase__InfluenzaA__ACQ84470
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuuuagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47277 - RNA, 1410 nt, Artificial Sequence
  neuraminidase__InfluenzaA__ACQ84480
augaauacaaaccaaagaauaauaaccaucgggacagucugucugauaguuggaauaguuagucuauuauugcagauaggaaauauagucucguuauggauaagccauucaauuaagacuggagaaaaaaaccacucugagauaugcaaccaaaauaucauuacauaugaaaacaaaacaugggugaaccaaacuuauguaaacauuagcaauaccaacauugcugauggacagggcgugacuucaauaauacuagccggcaauuccucucuuugcccaauaagugggugggcuauauacagcaaagacaauagcauaaggauugguuccaaaggagacauuuuugucauaagagaaccauucauuucaugcucucacuuggagugcagaaccuuuuuucugacccaaggugcuuugcuaaaugacaggcauucuaauggaaccgucaaggacaggagcccuuaccgaaccuuaaugagcugcccgaccggugaagcuccaucuccguauaauucaagauuugaaucaguugcuuggucagcaagugcaugccaugauggaaugggauggcuaacaaucgggauuuccgguccagauaauggagcaguggcuguuuugaaauacaaugguauaauaacagauacaauaaaaaguuggagaaacaaaauacuaagaacacaagagucagaauguguuuguauaaacgguucauguuuuacuauaaugacugauggcccaagcaaugggcaagccucguacaaaauauucaaaauggagaaagggaagauuauuaagucaguugagcuggaugcaccuaauuaccacuaugaggaaugcuccuguuacccugauacaggcaaaguggugugugugugcagagacaauuggcaugcuucaaaucgaccgugggucucuuucgaucagaaucuugauuaucagauaggguacauaugcagugggguuuucggugauaacccgcguucuaaugaugggaaaggcaauuguggcccaguacuuucuaauggagcaaauggagugaaaggauucucauuuagauauggcaaugguguuuggauaggaagaacuaaaaguaucagcucuagaaguggauuugagaugauuugggauccaaauggauggacggaaacugauaguaguuucucuauaaagcaggauauuauagcauuaacugauuggucaggauacaguggaaguuuuguccaacauccugaauuaacaggaaugaacugcauaaggccuuguuuuuggguagaguuaaucagaggacaacccaaggagagcacaaucuggacuaguggaagcagcauuucuuucuguggcguggacagugaaaccgcaagcuggucauggccagacggagcugaucugccauucaccauugacaaguag

SEQ ID NO: 47278 - RNA, 1410 nt, Artificial Sequence
  neuraminidase__InfluenzaA__ACQ89891
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggaauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugccgugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47279 - RNA, 1410 nt, Artificial Sequence; identical to SEQ ID NO: 47253
  neuraminidase__InfluenzaA__ACQ89918

SEQ ID NO: 47280 - RNA, 1410 nt, Artificial Sequence
  neuraminidase__InfluenzaA__ACQ89919
augaauccaaaccaaaagauaauaaccauugguucggucuguaugacaauuggaauggcuaacuuaauauuacaaauuggaaacauaaucucaauauggauuagccgcucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47281 - RNA, 1410 nt, Artificial Sequence; identical to SEQ ID NO: 47242
  neuraminidase__InfluenzaA__ACQ89920

SEQ ID NO: 47282 - RNA, 1410 nt, Artificial Sequence; identical to SEQ ID NO: 47242
  neuraminidase__InfluenzaA__ACQ89921

SEQ ID NO: 47283 - RNA, 1410 nt, Artificial Sequence; identical to SEQ ID NO: 47253
  neuraminidase__InfluenzaA__ACQ89922

SEQ ID NO: 47284 - RNA, 1410 nt, Artificial Sequence; identical to SEQ ID NO: 47242
  neuraminidase__InfluenzaA__ACQ89923

SEQ ID NO: 47285 - RNA, 1410 nt, Artificial Sequence; identical to SEQ ID NO: 47241
  neuraminidase__InfluenzaA__ACQ99623

SEQ ID NO: 47286 - RNA, 1410 nt, Artificial Sequence
  neuraminidase__InfluenzaA__ACQ99624
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47287 - RNA, 1410 nt, Artificial Sequence; identical to SEQ ID NO: 47241
  neuraminidase__InfluenzaA__ACQ99626

SEQ ID NO: 47288 - RNA, 1410 nt, Artificial Sequence; identical to SEQ ID NO: 47241
  neuraminidase__InfluenzaA__ACQ99627

SEQ ID NO: 47289 - RNA, 1410 nt, Artificial Sequence; identical to SEQ ID NO: 47241
  neuraminidase__InfluenzaA__ACQ99628

SEQ ID NO: 47290 - RNA, 1410 nt, Artificial Sequence; identical to SEQ ID NO: 47241
  neuraminidase__InfluenzaA__ACQ99629

SEQ ID NO: 47291 - RNA, 1410 nt, Artificial Sequence; identical to SEQ ID NO: 47241
  neuraminidase__InfluenzaA__ACQ99630

SEQ ID NO: 47292 - RNA, 1410 nt, Artificial Sequence
  neuraminidase__InfluenzaA__ACQ99632
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagauaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47293 - RNA, 1410 nt, Artificial Sequence; identical to SEQ ID NO: 47292
  neuraminidase__InfluenzaA__ACQ99633

SEQ ID NO: 47294 - RNA, 1410 nt, Artificial Sequence; identical to SEQ ID NO: 47241
  neuraminidase__InfluenzaA__ACQ99635

SEQ ID NO: 47295 - RNA, 1410 nt, Artificial Sequence; identical to SEQ ID NO: 47241
  neuraminidase__InfluenzaA__ACQ99636

SEQ ID NO: 47296 - RNA, 1410 nt, Artificial Sequence
  neuraminidase__InfluenzaA__ACQ99684
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugaugaacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47297 - RNA, 1410 nt, Artificial Sequence
  neuraminidase__InfluenzaA__ACQ99824
augaauacaaaucaaagaauaauaaccauugggacaaucugucuaauaguuggaauaauuagucuauuauugcagauaggaaauauaaucuuguuauggaugagccauucaauucagacuggagaaaaaagccauccuaagguaugcaaccaaagugucauuaccuaugaaaacaacacaugggugaaccagacuuauguaaacauuagcaauaccaauauugcugcuggacagggugugacuccaauaauacuagccggcaauuccucucuuugcccaaucagugggugggcuauauacagcaaagacaauagcauaaggauugguuccaaaggagacauuuuugucaugagagagccauucauuucaugcucucacuuggaaugcagaaccuuuuuucugacccaaggcgcuuugcugaaugacaggcauucuaauggaaccgucaaggacaggaguccuuauagaaccuuaaugagcugccccaucggugaagcuccaucuccguacaauucaagguucgaaucaguugcuuggucagcaagugcaugccaugauggaaugggauggcuaacaaucgggauuuccgguccagauaauggagcaguggcuguuuuaaaauacaaugguauaauaacagauacaauaaaaaguuggagaaacaaaauauuaagaacacaagagucugaauguguuuguauaaacgguucguguuuuacuauaaugacugacggcccaagcaaugggcaagccucguacaaauuauucaaaauggagaaagggaagauuauuaagucaauugagcuggaugcaccuaauuaccacuaugaggaaugcuccuguuacccugauacaggcaaaguggugugugugugcagagacaauuggcaugcuucgaaucgaccaugggucucuuucgaucagaaucuugauuaucaaauaggguacauaugcagugggguuuucggugauaauccgcguucuaaugaugggaaaggcaauuguggcccaguacuuucuaauggagcaaauggagugaagggguuuucauuuagauauggcaaugguguuuggauaggaagaacuaaaaguaucagcucuagaaguggauuugagaugauuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguagaguuaaucagagggcaacccaaggagagcacaaucuggacuaguggaagcagcauuucuuucuguggcgugaacaguggcacugcaagcuggucauggccagacggagcugaucugccauucaccauugacaaguag

SEQ ID NO: 47298 - RNA, 1410 nt, Artificial Sequence
  neuraminidase__InfluenzaA__ACR01015
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47299 - RNA, 1410 nt, Artificial Sequence; identical to SEQ ID NO: 47242
  neuraminidase__InfluenzaA__ACR08422

SEQ ID NO: 47300 - RNA, 1410 nt, Artificial Sequence; identical to SEQ ID NO: 47242
  neuraminidase__InfluenzaA__ACR08432

SEQ ID NO: 47301 - RNA, 1410 nt, Artificial Sequence; identical to SEQ ID NO: 47242
  neuraminidase__InfluenzaA__ACR08442

SEQ ID NO: 47302 - RNA, 1410 nt, Artificial Sequence; identical to SEQ ID NO: 47242
  neuraminidase__InfluenzaA__ACR08452

SEQ ID NO: 47303 - RNA, 1410 nt, Artificial Sequence
  neuraminidase__InfluenzaA__ACR08462
augaguccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47304 - RNA, 1410 nt, Artificial Sequence
  neuraminidase__InfluenzaA__ACR08565
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47305 - RNA, 1410 nt, Artificial Sequence
  neuraminidase__InfluenzaA__ACR08566
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47306 - RNA, 1410 nt, Artificial Sequence
  neuraminidase__InfluenzaA__ACR08567
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47307 - RNA, 1410 nt, Artificial Sequence
  neuraminidase__InfluenzaA__ACR08568
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggcuacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47308 - RNA, 1410 nt, Artificial Sequence; identical to SEQ ID NO: 47241
  neuraminidase__InfluenzaA__ACR08569

SEQ ID NO: 47309 - RNA, 1410 nt, Artificial Sequence; identical to SEQ ID NO: 47242
  neuraminidase__InfluenzaA__ACR08570

SEQ ID NO: 47310 - RNA, 1410 nt, Artificial Sequence; identical to SEQ ID NO: 47241
  neuraminidase__InfluenzaA__ACR08571

SEQ ID NO: 47311 - RNA, 1410 nt, Artificial Sequence; identical to SEQ ID NO: 47241
  neuraminidase__InfluenzaA__ACR08572

SEQ ID NO: 47312 - RNA, 1410 nt, Artificial Sequence; identical to SEQ ID NO: 47262
  neuraminidase__InfluenzaA__ACR08573

SEQ ID NO: 47313 - RNA, 1410 nt, Artificial Sequence; identical to SEQ ID NO: 47241
  neuraminidase__InfluenzaA__ACR08574

SEQ ID NO: 47314 - RNA, 1410 nt, Artificial Sequence; identical to SEQ ID NO: 47242
  neuraminidase__InfluenzaA__ACR08576

SEQ ID NO: 47315 - RNA, 1410 nt, Artificial Sequence; identical to SEQ ID NO: 47241
  neuraminidase__InfluenzaA__ACR08577

SEQ ID NO: 47316 - RNA, 1410 nt, Artificial Sequence; identical to SEQ ID NO: 47241
  neuraminidase__InfluenzaA__ACR09378

SEQ ID NO: 47317 - RNA, 1410 nt, Artificial Sequence; identical to SEQ ID NO: 47241
  neuraminidase__InfluenzaA__ACR09379

SEQ ID NO: 47318 - RNA, 1410 nt, Artificial Sequence
  neuraminidase__InfluenzaA__ACR09380
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucguacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47319 - RNA, 1410 nt, Artificial Sequence; identical to SEQ ID NO: 47275
  neuraminidase__InfluenzaA__ACR09381

SEQ ID NO: 47320 - RNA, 1410 nt, Artificial Sequence; identical to SEQ ID NO: 47241
  neuraminidase__InfluenzaA__ACR09382

SEQ ID NO: 47321 - RNA, 1410 nt, Artificial Sequence; identical to SEQ ID NO: 47292
  neuraminidase__InfluenzaA__ACR09383

SEQ ID NO: 47322 - RNA, 1410 nt, Artificial Sequence; identical to SEQ ID NO: 47241
  neuraminidase__InfluenzaA__ACR09384

SEQ ID NO: 47323 - RNA, 1410 nt, Artificial Sequence; identical to SEQ ID NO: 47242
  neuraminidase__InfluenzaA__ACR09385

SEQ ID NO: 47324 - RNA, 1410 nt, Artificial Sequence
  neuraminidase__InfluenzaA__ACR09386
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuuuuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47325 - RNA, 1410 nt, Artificial Sequence; identical to SEQ ID NO: 47242
  neuraminidase__InfluenzaA__ACR10189

SEQ ID NO: 47326 - RNA, 1410 nt, Artificial Sequence; identical to SEQ ID NO: 47242
  neuraminidase__InfluenzaA__ACR10226

SEQ ID NO: 47327 - RNA, 1410 nt, Artificial Sequence
  neuraminidase__InfluenzaA__ACR10236
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagacaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47328 - RNA, 1410 nt, Artificial Sequence; identical to SEQ ID NO: 47327
  neuraminidase__InfluenzaA__ACR10237

SEQ ID NO: 47329 - RNA, 1410 nt, Artificial Sequence
  neuraminidase__InfluenzaA__ACR15186
augaauccaaaucaaaagauaauaacgauuggcucuguuucucucaccauuuccacaauaugcuucuucaugcaaauugccaucuuaauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgacauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47330 - RNA, 1413 nt, Artificial Sequence
  neuraminidase__InfluenzaA__ACR15197
augaacccaaaucaaaagauaauaaccauuggaucaaucaguauagcaaucggaauaauuaguuuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucucuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagccguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaaaaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47331 - RNA, 1410 nt, Artificial Sequence
  neuraminidase__InfluenzaA__ACR15208
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47332 - RNA, 1410 nt, Artificial Sequence
  neuraminidase__InfluenzaA__ACR15230
auggauccaaaucaaaagauaauaacgauuggcucuguuucucucaccauuuccgcaauaugcuucuucaugcaaauugcuauucugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggagacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuggguguuccauuucaucuggggaccaagcaagugugcauagcaugguccagcucaaguugucacgauggaaaagcauggcugcauguuuguguaacgggggaugaugaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggauccaauaggcccaucguagauauaaacauaaaggauuauagcauuguuuccagcuaugugugcucaggacuuguuggagacacacccagaaaaaacgacagcuccagcaauagccauugcuuggauccaaacaaugaagaagguggucauggagugaaaggcugggccuuugaugaugggaaugacguguggaugggaagaacgaucagcgagaaguuacgcucaggauaugaaaccuucaaagucauugaaggcugguccaauccuaauuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47333 - RNA, 1413 nt, Artificial Sequence
  neuraminidase__InfluenzaA__ACR15241
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacgacaaucuggacuagugggagcagcauuucuuuuuguggcguuaauagugauacugcaaacuggucuuggccagacggugcugaguugccguucaccauugacaaguag

SEQ ID NO: 47334 - RNA, 1410 nt, Artificial Sequence
  neuraminidase__InfluenzaA__ACR15252
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaagggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggcaauagguccgguuauucugguauuuucucuguugaaggcaaaagcugcaucaaucggugcuuuuauguggaguugauaaggggaagaaaggaggaaacugaagucuuguggaccucaaacaguauuguuguguuuuguggcaccucagguacauauggaacaggcucauggccugauggggcggacaucaaucucaugccuauauaa

SEQ ID NO: 47335 - RNA, 1413 nt, Artificial Sequence
  neuraminidase__InfluenzaA__ACR15263
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaauggaaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggucuagugggagcagcauuucuuuuuguggcguuaauagugauacugcaaacuggucuuggccagacggugcugaguugccguucaccauugacaaguag

SEQ ID NO: 47336 - RNA, 1413 nt, Artificial Sequence
  neuraminidase__InfluenzaA__ACR15274
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaauggaaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47337 - RNA, 1413 nt, Artificial Sequence
  neuraminidase__InfluenzaA__ACR15307
augaauccaaaucaaaaaauaauaaccauuggaucaaucaguauaacaaucggaauaauuagucuaauguugcaaauaggaaauauuauuucaauaugggcuagucacucaauccaaacuggaagucaaaaccacacuggaauaugcaaccaaagaaucaucacauaugaaaacaacaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguuaaggacagaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggcauaauaacugaaaccauaaaaaguuggaaaaagcgaauauuaagaacacaagagucugaaugugucugugugaacgggucauguuucaccauaaugaccgauggcccgaguaauggggccgccucguacaaaaucuucaagaucgaaaaggggaagguuacuaaaucaauagaguugaaugcacccaauuuucauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauaccgcaaacuggucuuggccagacggugcugaguugccguucaccauugacaaguag

SEQ ID NO: 47338 - RNA, 1413 nt, Artificial Sequence
  neuraminidase__InfluenzaA__ACR15318
augaauccaaaucaaaaaauaauaaccauuggaucaaucaguauagcaaucggaauaauuagccuaauguugcaaauaggaaacauuauuucaauaugggcuagucacucaauccaaacuggaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacucaaggugcucuauuaaaugacaaacauucaaaugggaccguuaaggacagaagccccuauagggcuuuaaugagcuguccucuaggugaagcuccguccccauacaauucaaaguuugaaucaguugcuuggucagcaagcgcaugccaugauggcaugggcugguuaacaaucggaauuucugguccagacaauggagcaguggcuguacuaaaauacaacggcauaauaacugaaaccauaaaaaguuggaaaaggcaaauauuaagaacacaagagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccuggguguccuuuaaucaaaaccuggauuaucaaauaggauacaucugcagugggguguucggugacaauccgcgucccaaagauggagagggcagcuguaauccagugacuguugauggagcaaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuuguggcguaaauagugauacugcaaacuggucuuggccagacggugcugaguugccguuuaccauugacaaguaa

SEQ ID NO: 47339 - RNA, 1413 nt, Artificial Sequence
  neuraminidase__InfluenzaA__ACR15329
augaauccaaaucaaaaaauaauaaccaucggaucaaucaguauagcaaucggaauaauuagccuaauguugcaaauaggaaacauuauuucaauaugggcuagucacucaauccaaacuagaagucaaaaccacacuggaguaugcaaccaaagaaucaucacauaugaaaacagcaccugggugaaucacacauauguuaauauuaacaacaccaauguuauugcuggaaaggacaaaacuucagugacauuggccggcaauucaucucuuuguucuaucaguggaugggcuauauacacaaaagacaacagcauaagaauugguuccaaaggagauguuuuugucauaagagagccuuucauaucauguucucacuuggaaugcagaaccuuuuuucugacccaaggugcucuauuaaaugacaaacauucaaaugggaccguuaaggacagaagccccuauagggcuuuaaugagcuguccucuaggugaagcuccguccccauacaauucaaaguuugaaucaguugcuuggucggcaagcgcaugccaugauggcaugggcugguuaacaaucggaauuucugguccagacaauggagcaguggcuguacuaaaauacaacggcauaauaacugaaaccauaaaaaguuggaaaaagcaaauauuaagaacacaggagucugaaugugucugugugaacgggucauguuucaccauaaugaccgauggcccgaguaauggggccgccucguacaaaaucuucaagaucgaaaagggaaagguuacuaaaucaauagaguugaaugcacccaauuuucauuaugaggaauguuccuguuacccagacacuggcacagugauguguguaugcagggacaacuggcaugguucaaaucgacccugggugucuuuuaaucaaaaccuggauuaucaaauaggauacaucugcagugggguguucggugacaauccgcgucccaaagauggagagggcagcuguaauccagugacuguugauggagcgaacggaguaaagggguuuucauacaaauaugguaaugguguuuggauaggaaggacuaaaaguaacagacuuagaaagggguuugagaugauuugggauccuaauggauggacagauaccgacagugauuucucagugaaacaggauguuguggcaauaacugauuggucuggguacagcggaaguuucguucaacauccugaguuaacaggauuggacuguauaagaccuugcuucuggguugaguuagucagaggacugccaaaagaaaauacaacaaucuggacuagugggagcagcauuucuuuuugugguguaaauagugauacugcaaacuggucuuggccagacggugcugaguugccguuuaccauugacaaguaa

SEQ ID NO: 47340 - RNA, 1413 nt, Artificial Sequence
  neuraminidase__InfluenzaA__ACR15340
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaauggaauaauaacuggaaccauaaaaaguuggaaaaagcaaauauuaagaacacaagagucugaaugugucuguaugaacgggucauguuucaccauaaugaccgauggcccgaguaacaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacgaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47341 - RNA, 1413 nt, Artificial Sequence; identical to SEQ ID NO: 47340
  neuraminidase__InfluenzaA__ACR15362

SEQ ID NO: 47342 - RNA, 1413 nt, Artificial Sequence
  neuraminidase__InfluenzaA__ACR15373
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggggauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaaaguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggaucccaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47343 - RNA, 1413 nt, Artificial Sequence
  neuraminidase__InfluenzaA__ACR15428
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucugucaguggaugggcuauauacacaaaagacaacagcauaagaauuggcuccaaaggagauguuuuugucauaagagaaccuuucauaucauguucucacuuggaaugcagaaccuuuuuucugaccaaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacgaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47344 - RNA, 1413 nt, Artificial Sequence
  neuraminidase__InfluenzaA__ACR15472
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuccagugacauuggccggcaauucaucucuuuguucuaucaguggaugggcuauauacacaaaagacaacagcauaagaauuggcuccaaaggagauguuuuugucauaagagaaccuuucauagcauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccugacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguucuuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugaggugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47345 - RNA, 1413 nt, Artificial Sequence; identical to SEQ ID NO: 47200
  neuraminidase__InfluenzaA__ACR15483

SEQ ID NO: 47346 - RNA, 1413 nt, Artificial Sequence; identical to SEQ ID NO: 47200
  neuraminidase__InfluenzaA__ACR15505

SEQ ID NO: 47347 - RNA, 1413 nt, Artificial Sequence; identical to SEQ ID NO: 47220
  neuraminidase__InfluenzaA__ACR15516

SEQ ID NO: 47348 - RNA, 1410 nt, Artificial Sequence
  neuraminidase__InfluenzaA__ACR15527
augaauccaaaucaaaagauaauaacgauuggcucuguuucucucaccauuuccacaauaugcuucuucaugcaaauugccaucuugauaacuacuguaacauugcauuucaaacaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaaaaaauccucaggacccaggagucagaaugcguuuguaucaauggaacuuguacaguaguaaugacugaugggagugcuucgggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggauggggagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47349 - RNA, 1410 nt, Artificial Sequence
  neuraminidase__InfluenzaA__ACR15538
augauuccaauucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucggaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauuacagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47350 - RNA, 1410 nt, Artificial Sequence
  neuraminidase__InfluenzaA__ACR15549
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 47351 - RNA, 1410 nt, Artificial Sequence
  neuraminidase__InfluenzaA__ACR15560
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaaccccaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47352 - RNA, 1410 nt, Artificial Sequence
  neuraminidase__InfluenzaA__ACR15582
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaccaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47353 - RNA, 1410 nt, Artificial Sequence
  neuraminidase__InfluenzaA__ACR15593
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacaagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47354 - RNA, 1410 nt, Artificial Sequence
  neuraminidase__InfluenzaA__ACR15604
augaauccaaaucaaaagauaauaacgauuggcucuguuucucucacaauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaaugacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaaguauuguggaccucaaacaguauuguuguguuuuguggcaccucagguacauauggaacaggcucauggccugauggggcggacaucaaucucaugccuauauaa

SEQ ID NO: 47355 - RNA, 1410 nt, Artificial Sequence; identical to SEQ ID NO: 47241
  neuraminidase__InfluenzaA__ACR15618

SEQ ID NO: 47356 - RNA, 1410 nt, Artificial Sequence; identical to SEQ ID NO: 47241
  neuraminidase__InfluenzaA__ACR18924

SEQ ID NO: 47357 - RNA, 1410 nt, Artificial Sequence; identical to SEQ ID NO: 47275
  neuraminidase__InfluenzaA__ACR18925

SEQ ID NO: 47358 - RNA, 1410 nt, Artificial Sequence; identical to SEQ ID NO: 47242
  neuraminidase__InfluenzaA__ACR18926

SEQ ID NO: 47359 - RNA, 1410 nt, Artificial Sequence; identical to SEQ ID NO: 47242
  neuraminidase__InfluenzaA__ACR18927

SEQ ID NO: 47360 - RNA, 1410 nt, Artificial Sequence; identical to SEQ ID NO: 47242
  neuraminidase__InfluenzaA__ACR18928

SEQ ID NO: 47361 - RNA, 1410 nt, Artificial Sequence; identical to SEQ ID NO: 47318
  neuraminidase__InfluenzaA__ACR18929

SEQ ID NO: 47362 - RNA, 1410 nt, Artificial Sequence
  neuraminidase__InfluenzaA__ACR18930
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47363 - RNA, 1410 nt, Artificial Sequence; identical to SEQ ID NO: 47242
  neuraminidase__InfluenzaA__ACR18931

SEQ ID NO: 47364 - RNA, 1410 nt, Artificial Sequence; identical to SEQ ID NO: 47242
  neuraminidase__InfluenzaA__ACR18933

SEQ ID NO: 47365 - RNA, 1410 nt, Artificial Sequence; identical to SEQ ID NO: 47262
  neuraminidase__InfluenzaA__ACR18934

SEQ ID NO: 47366 - RNA, 1410 nt, Artificial Sequence; identical to SEQ ID NO: 47242
  neuraminidase__InfluenzaA__ACR18935

SEQ ID NO: 47367 - RNA, 1410 nt, Artificial Sequence; identical to SEQ ID NO: 47298
  neuraminidase__InfluenzaA__ACR23301

SEQ ID NO: 47368 - RNA, 1410 nt, Artificial Sequence; identical to SEQ ID NO: 47242
  neuraminidase__InfluenzaA__ACR32997

SEQ ID NO: 47369 - RNA, 1410 nt, Artificial Sequence
  neuraminidase__InfluenzaA__ACR33740
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacaguggcacuguggguuggucuuggccagacggugcugaguugccauuuaccauugacaaguaa

SEQ ID NO: 47370 - RNA, 1410 nt, Artificial Sequence; identical to SEQ ID NO: 47264
  neuraminidase__InfluenzaA__ACR38792

SEQ ID NO: 47371 - RNA, 1410 nt, Artificial Sequence; identical to SEQ ID NO: 47242
  neuraminidase__InfluenzaA__ACR38793

SEQ ID NO: 47372 - RNA, 1410 nt, Artificial Sequence; identical to SEQ ID NO: 47242
  neuraminidase__InfluenzaA__ACR38794

SEQ ID NO: 47373 - RNA, 1410 nt, Artificial Sequence; identical to SEQ ID NO: 47242
  neuraminidase__InfluenzaA__ACR38878

SEQ ID NO: 47374 - RNA, 1410 nt, Artificial Sequence; identical to SEQ ID NO: 47242
  neuraminidase__InfluenzaA__ACR39357

SEQ ID NO: 47375 - RNA, 1410 nt, Artificial Sequence; identical to SEQ ID NO: 47242
  neuraminidase__InfluenzaA__ACR39396

SEQ ID NO: 47376 - RNA, 1410 nt, Artificial Sequence; identical to SEQ ID NO: 47242
  neuraminidase__InfluenzaA__ACR39406

SEQ ID NO: 47377 - RNA, 1410 nt, Artificial Sequence; identical to SEQ ID NO: 47242
  neuraminidase__InfluenzaA__ACR39416

SEQ ID NO: 47378 - RNA, 1410 nt, Artificial Sequence; identical to SEQ ID NO: 47242
  neuraminidase__InfluenzaA__ACR39426

SEQ ID NO: 47379 - RNA, 1410 nt, Artificial Sequence
  neuraminidase__InfluenzaA__ACR39436
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47380 - RNA, 1410 nt, Artificial Sequence; identical to SEQ ID NO: 47242
  neuraminidase__InfluenzaA__ACR39446

SEQ ID NO: 47381 - RNA, 1410 nt, Artificial Sequence; identical to SEQ ID NO: 47242
  neuraminidase__InfluenzaA__ACR39456

SEQ ID NO: 47382 - RNA, 1410 nt, Artificial Sequence; identical to SEQ ID NO: 47242
  neuraminidase__InfluenzaA__ACR39466

SEQ ID NO: 47383 - RNA, 1410 nt, Artificial Sequence; identical to SEQ ID NO: 47242
  neuraminidase__InfluenzaA__ACR39476

SEQ ID NO: 47384 - RNA, 1410 nt, Artificial Sequence
  neuraminidase__InfluenzaA__ACR39486
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagugucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47385 - RNA, 1410 nt, Artificial Sequence; identical to SEQ ID NO: 47242
  neuraminidase__InfluenzaA__ACR39496

SEQ ID NO: 47386 - RNA, 1410 nt, Artificial Sequence; identical to SEQ ID NO: 47242
  neuraminidase__InfluenzaA__ACR40291

SEQ ID NO: 47387 - RNA, 1410 nt, Artificial Sequence; identical to SEQ ID NO: 47242
  neuraminidase__InfluenzaA__ACR40301

SEQ ID NO: 47388 - RNA, 1410 nt, Artificial Sequence
  neuraminidase__InfluenzaA__ACR40311
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47389 - RNA, 1410 nt, Artificial Sequence
  neuraminidase__InfluenzaA__ACR40321
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggaaugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47390 - RNA, 1410 nt, Artificial Sequence; identical to SEQ ID NO: 47242
  neuraminidase__InfluenzaA__ACR40341

SEQ ID NO: 47391 - RNA, 1410 nt, Artificial Sequence; identical to SEQ ID NO: 47242
  neuraminidase__InfluenzaA__ACR40351

SEQ ID NO: 47392 - RNA, 1410 nt, Artificial Sequence; identical to SEQ ID NO: 47242
  neuraminidase__InfluenzaA__ACR40361

SEQ ID NO: 47393 - RNA, 1410 nt, Artificial Sequence; identical to SEQ ID NO: 47242
  neuraminidase__InfluenzaA__ACR40371

SEQ ID NO: 47394 - RNA, 1410 nt, Artificial Sequence; identical to SEQ ID NO: 47242
  neuraminidase__InfluenzaA__ACR40391

SEQ ID NO: 47395 - RNA, 1410 nt, Artificial Sequence; identical to SEQ ID NO: 47241
  neuraminidase__InfluenzaA__ACR46663

SEQ ID NO: 47396 - RNA, 1410 nt, Artificial Sequence; identical to SEQ ID NO: 47241
  neuraminidase__InfluenzaA__ACR46673

SEQ ID NO: 47397 - RNA, 1410 nt, Artificial Sequence
  neuraminidase__InfluenzaA__ACR46996
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47398 - RNA, 1410 nt, Artificial Sequence
  neuraminidase__InfluenzaA__ACR46997
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaaaaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47399 - RNA, 1410 nt, Artificial Sequence; identical to SEQ ID NO: 47397
  neuraminidase__InfluenzaA__ACR46998

SEQ ID NO: 47400 - RNA, 1410 nt, Artificial Sequence; identical to SEQ ID NO: 47397
  neuraminidase__InfluenzaA__ACR46999

SEQ ID NO: 47401 - RNA, 1410 nt, Artificial Sequence; identical to SEQ ID NO: 47397
  neuraminidase__InfluenzaA__ACR47000

SEQ ID NO: 47402 - RNA, 1410 nt, Artificial Sequence; identical to SEQ ID NO: 47397
  neuraminidase__InfluenzaA__ACR47001

SEQ ID NO: 47403 - RNA, 1410 nt, Artificial Sequence; identical to SEQ ID NO: 47397
  neuraminidase__InfluenzaA__ACR47002

SEQ ID NO: 47404 - RNA, 1410 nt, Artificial Sequence; identical to SEQ ID NO: 47397
  neuraminidase__InfluenzaA__ACR47003

SEQ ID NO: 47405 - RNA, 1410 nt, Artificial Sequence
  neuraminidase__InfluenzaA__ACR47008
augaauccaaaccaaaagauaauaaccauugguucggucuguaugacaauuggaauggcuaacuuaauauuacaaauuggaaacauaaucucaauauggccaguccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47406 - RNA, 1410 nt, Artificial Sequence; identical to SEQ ID NO: 47242
  neuraminidase__InfluenzaA__ACR49267

SEQ ID NO: 47407 - RNA, 1410 nt, Artificial Sequence; identical to SEQ ID NO: 47265
  neuraminidase__InfluenzaA__ACR49268

SEQ ID NO: 47408 - RNA, 1410 nt, Artificial Sequence; identical to SEQ ID NO: 47241
  neuraminidase__InfluenzaA__ACR49269

SEQ ID NO: 47409 - RNA, 1410 nt, Artificial Sequence; identical to SEQ ID NO: 47241
  neuraminidase__InfluenzaA__ACR49270

SEQ ID NO: 47410 - RNA, 1410 nt, Artificial Sequence; identical to SEQ ID NO: 47272
  neuraminidase__InfluenzaA__ACR49271

SEQ ID NO: 47411 - RNA, 1410 nt, Artificial Sequence; identical to SEQ ID NO: 47379
  neuraminidase__InfluenzaA__ACR49272

SEQ ID NO: 47412 - RNA, 1410 nt, Artificial Sequence; identical to SEQ ID NO: 47241
  neuraminidase__InfluenzaA__ACR49273

SEQ ID NO: 47413 - RNA, 1410 nt, Artificial Sequence; identical to SEQ ID NO: 47241
  neuraminidase__InfluenzaA__ACR49274

SEQ ID NO: 47414 - RNA, 1410 nt, Artificial Sequence; identical to SEQ ID NO: 47272
  neuraminidase__InfluenzaA__ACR49275

SEQ ID NO: 47415 - RNA, 1410 nt, Artificial Sequence; identical to SEQ ID NO: 47272
  neuraminidase__InfluenzaA__ACR49277

SEQ ID NO: 47416 - RNA, 1410 nt, Artificial Sequence; identical to SEQ ID NO: 47272
  neuraminidase__InfluenzaA__ACR49278

SEQ ID NO: 47417 - RNA, 1410 nt, Artificial Sequence; identical to SEQ ID NO: 47241
  neuraminidase__InfluenzaA__ACR49279

SEQ ID NO: 47418 - RNA, 1410 nt, Artificial Sequence; identical to SEQ ID NO: 47241
  neuraminidase__InfluenzaA__ACR50994

SEQ ID NO: 47419 - RNA, 1410 nt, Artificial Sequence; identical to SEQ ID NO: 47379
  neuraminidase__InfluenzaA__ACR50998

SEQ ID NO: 47420 - RNA, 1410 nt, Artificial Sequence; identical to SEQ ID NO: 47242
  neuraminidase__InfluenzaA__ACR51008

SEQ ID NO: 47421 - RNA, 1410 nt, Artificial Sequence; identical to SEQ ID NO: 47242
  neuraminidase__InfluenzaA__ACR51018

SEQ ID NO: 47422 - RNA, 1410 nt, Artificial Sequence; identical to SEQ ID NO: 47242
  neuraminidase__InfluenzaA__ACR51028

SEQ ID NO: 47423 - RNA, 1410 nt, Artificial Sequence
  neuraminidase__InfluenzaA__ACR51038
augaauccaaaccaaaagauaauaaccauugguucggucuguaugucaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47424 - RNA, 1410 nt, Artificial Sequence; identical to SEQ ID NO: 47242
  neuraminidase__InfluenzaA__ACR51048

SEQ ID NO: 47425 - RNA, 1410 nt, Artificial Sequence; identical to SEQ ID NO: 47242
  neuraminidase__InfluenzaA__ACR51058

SEQ ID NO: 47426 - RNA, 1410 nt, Artificial Sequence; identical to SEQ ID NO: 47241
  neuraminidase__InfluenzaA__ACR51068

SEQ ID NO: 47427 - RNA, 1410 nt, Artificial Sequence; identical to SEQ ID NO: 47242
  neuraminidase__InfluenzaA__ACR52371

SEQ ID NO: 47428 - RNA, 1410 nt, Artificial Sequence; identical to SEQ ID NO: 47242
  neuraminidase__InfluenzaA__ACR52381

SEQ ID NO: 47429 - RNA, 1410 nt, Artificial Sequence; identical to SEQ ID NO: 47242
  neuraminidase__InfluenzaA__ACR52391

SEQ ID NO: 47430 - RNA, 1410 nt, Artificial Sequence; identical to SEQ ID NO: 47242
  neuraminidase__InfluenzaA__ACR52401

SEQ ID NO: 47431 - RNA, 1410 nt, Artificial Sequence; identical to SEQ ID NO: 47242
  neuraminidase__InfluenzaA__ACR52411

SEQ ID NO: 47432 - RNA, 1410 nt, Artificial Sequence; identical to SEQ ID NO: 47242
  neuraminidase__InfluenzaA__ACR52421

SEQ ID NO: 47433 - RNA, 1410 nt, Artificial Sequence; identical to SEQ ID NO: 47242
  neuraminidase__InfluenzaA__ACR52431

SEQ ID NO: 47434 - RNA, 1410 nt, Artificial Sequence; identical to SEQ ID NO: 47242
  neuraminidase__InfluenzaA__ACR52441

SEQ ID NO: 47435 - RNA, 1410 nt, Artificial Sequence; identical to SEQ ID NO: 47242
  neuraminidase__InfluenzaA__ACR52451

SEQ ID NO: 47436 - RNA, 1410 nt, Artificial Sequence; identical to SEQ ID NO: 47242
  neuraminidase__InfluenzaA__ACR52471

SEQ ID NO: 47437 - RNA, 1410 nt, Artificial Sequence; identical to SEQ ID NO: 47242
  neuraminidase__InfluenzaA__ACR52481

SEQ ID NO: 47438 - RNA, 1410 nt, Artificial Sequence; identical to SEQ ID NO: 47242
  neuraminidase__InfluenzaA__ACR52491

SEQ ID NO: 47439 - RNA, 1410 nt, Artificial Sequence
  neuraminidase__InfluenzaA__ACR54046
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47440 - RNA, 1410 nt, Artificial Sequence; identical to SEQ ID NO: 47253
  neuraminidase__InfluenzaA__ACR54052

SEQ ID NO: 47441 - RNA, 1410 nt, Artificial Sequence
  neuraminidase__InfluenzaA__ACR54966
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47442 - RNA, 1410 nt, Artificial Sequence; identical to SEQ ID NO: 47242
  neuraminidase__InfluenzaA__ACR54976

SEQ ID NO: 47443 - RNA, 1410 nt, Artificial Sequence; identical to SEQ ID NO: 47362
  neuraminidase__InfluenzaA__ACR54986

SEQ ID NO: 47444 - RNA, 1410 nt, Artificial Sequence; identical to SEQ ID NO: 47305
  neuraminidase__InfluenzaA__ACR54996

SEQ ID NO: 47445 - RNA, 1410 nt, Artificial Sequence
  neuraminidase__InfluenzaA__ACR55006
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47446 - RNA, 1410 nt, Artificial Sequence; identical to SEQ ID NO: 47241
  neuraminidase__InfluenzaA__ACR56383

SEQ ID NO: 47447 - RNA, 1410 nt, Artificial Sequence; identical to SEQ ID NO: 47241
  neuraminidase__InfluenzaA__ACR56393

SEQ ID NO: 47448 - RNA, 1410 nt, Artificial Sequence; identical to SEQ ID NO: 47242
  neuraminidase__InfluenzaA__ACR56403

SEQ ID NO: 47449 - RNA, 1410 nt, Artificial Sequence; identical to SEQ ID NO: 47242
  neuraminidase__InfluenzaA__ACR56413

SEQ ID NO: 47450 - RNA, 1410 nt, Artificial Sequence; identical to SEQ ID NO: 47242
  neuraminidase__InfluenzaA__ACR56423

SEQ ID NO: 47451 - RNA, 1410 nt, Artificial Sequence; identical to SEQ ID NO: 47242
  neuraminidase__InfluenzaA__ACR56433

SEQ ID NO: 47452 - RNA, 1410 nt, Artificial Sequence; identical to SEQ ID NO: 47242
  neuraminidase__InfluenzaA__ACR56443

SEQ ID NO: 47453 - RNA, 1410 nt, Artificial Sequence; identical to SEQ ID NO: 47379
  neuraminidase__InfluenzaA__ACR56453

SEQ ID NO: 47454 - RNA, 1413 nt, Artificial Sequence; identical to SEQ ID NO: 47220
  neuraminidase__InfluenzaA__ACR58555

SEQ ID NO: 47455 - RNA, 1413 nt, Artificial Sequence
  neuraminidase__InfluenzaA__ACR61658
augaauccaaaucaaaaaauaauaaccauuggaucaaucaguauagcaaucgggauaauuagucuaauguugcaaauaggaaauauuauuucaauaugggcuagucacucaauccaaacuggaagucaaaaccacacuggaauaugcaaccaaagaaucaucacauaugaaaacagcaccugggugaaucacacauauguuaguauuaacaacacuaauguuguuacuggaaaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcaggaccuuuuuucugacccaaggugcucuauuaaaugacaaacauucaaauggaaccguuaaggaccgaaguccuuauagggccuuaaugagcuguccucuaggugaagcuccguccccauacaauucaaaguuugaaucaguugcauggucagcaagcgcaugccaugauggcaugggcugguuaacaaucggaauuucugguccagacaauggagcuguggcuguacuaaaauacaacggaauaauaacugaaaccauaaaaaguuggaaaaagcgaauauugagaacacaagagucugaaugugucugugugaacgggucauguuucaccauaaugaccgauggcccgaguaauggggccgccucguacaaaaucuucaaaaucgaaaaggggaagguuacuaaaucaauagaguuaaaugcacccaauuuucauuaugaggaauguuccuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggaaagggcagcuguaauccagugacuguugauggagcagacgggguuaagggguuuucauacaaauaugguaaugguguuuggauaggaagaacuaaaaguaacagacuuagaaagggguuugagaugauuugggauccuaauggauggacagauaccgacagugauuucucagugaaacaggauguuguggcaauaacugauuggucaggguacaguggaaguuucguucaacauccugaguuaacaggauuggacuguauaagaccuugcuucuggguugaguuagucagaggacugccuagagaaaauacaacaaucuggacuagugggagcagcauuucuuuuuguggcguugauagugauacugcaaacuggucuuggccagacggugcugaguugccguucaccauugacaaguag

SEQ ID NO: 47456 - RNA, 1410 nt, Artificial Sequence
  neuraminidase__InfluenzaA__ACR61680
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguauaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47457 - RNA, 1410 nt, Artificial Sequence
  neuraminidase__InfluenzaA__ACR61691
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccacaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47458 - RNA, 1410 nt, Artificial Sequence
  neuraminidase__InfluenzaA__ACR61702
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacaguuccagcaguagcaauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47459 - RNA, 1410 nt, Artificial Sequence
  neuraminidase__InfluenzaA__ACR67201
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccauauacagcaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47460 - RNA, 1410 nt, Artificial Sequence; identical to SEQ ID NO: 47242
  neuraminidase__InfluenzaA__ACR67202

SEQ ID NO: 47461 - RNA, 1410 nt, Artificial Sequence; identical to SEQ ID NO: 47275
  neuraminidase__InfluenzaA__ACR67203

SEQ ID NO: 47462 - RNA, 1410 nt, Artificial Sequence; identical to SEQ ID NO: 47242
  neuraminidase__InfluenzaA__ACR67204

SEQ ID NO: 47463 - RNA, 1410 nt, Artificial Sequence; identical to SEQ ID NO: 47439
  neuraminidase__InfluenzaA__ACR67246

SEQ ID NO: 47464 - RNA, 1410 nt, Artificial Sequence; identical to SEQ ID NO: 47305
  neuraminidase__InfluenzaA__ACR67256

SEQ ID NO: 47465 - RNA, 1410 nt, Artificial Sequence; identical to SEQ ID NO: 47242
  neuraminidase__InfluenzaA__ACR77451

SEQ ID NO: 47466 - RNA, 1410 nt, Artificial Sequence; identical to SEQ ID NO: 47379
  neuraminidase__InfluenzaA__ACR77461

SEQ ID NO: 47467 - RNA, 1410 nt, Artificial Sequence; identical to SEQ ID NO: 47242
  neuraminidase__InfluenzaA__ACR77471

SEQ ID NO: 47468 - RNA, 1410 nt, Artificial Sequence; identical to SEQ ID NO: 47242
  neuraminidase__InfluenzaA__ACR77481

SEQ ID NO: 47469 - RNA, 1410 nt, Artificial Sequence; identical to SEQ ID NO: 47242
  neuraminidase__InfluenzaA__ACR77491

SEQ ID NO: 47470 - RNA, 1410 nt, Artificial Sequence; identical to SEQ ID NO: 47242
  neuraminidase__InfluenzaA__ACR77501

SEQ ID NO: 47471 - RNA, 1410 nt, Artificial Sequence; identical to SEQ ID NO: 47242
  neuraminidase__InfluenzaA__ACR83527

SEQ ID NO: 47472 - RNA, 1410 nt, Artificial Sequence; identical to SEQ ID NO: 47439
  neuraminidase__InfluenzaA__ACR83539

SEQ ID NO: 47473 - RNA, 1410 nt, Artificial Sequence; identical to SEQ ID NO: 47242
  neuraminidase__InfluenzaA__ACS14669

SEQ ID NO: 47474 - RNA, 1410 nt, Artificial Sequence; identical to SEQ ID NO: 47242
  neuraminidase__InfluenzaA__ACS14679

SEQ ID NO: 47475 - RNA, 1410 nt, Artificial Sequence; identical to SEQ ID NO: 47242
  neuraminidase__InfluenzaA__ACS14689

SEQ ID NO: 47476 - RNA, 1410 nt, Artificial Sequence; identical to SEQ ID NO: 47242
  neuraminidase__InfluenzaA__ACS14699

SEQ ID NO: 47477 - RNA, 1410 nt, Artificial Sequence; identical to SEQ ID NO: 47242
  neuraminidase__InfluenzaA__ACS14709

SEQ ID NO: 47478 - RNA, 1410 nt, Artificial Sequence; identical to SEQ ID NO: 47242
  neuraminidase__InfluenzaA__ACS14719

SEQ ID NO: 47479 - RNA, 1410 nt, Artificial Sequence; identical to SEQ ID NO: 47242
  neuraminidase__InfluenzaA__ACS14729

SEQ ID NO: 47480 - RNA, 1410 nt, Artificial Sequence; identical to SEQ ID NO: 47242
  neuraminidase__InfluenzaA__ACS14739

SEQ ID NO: 47481 - RNA, 1410 nt, Artificial Sequence
  neuraminidase__InfluenzaA__ACS27192
augaauccaaaccaaaagauaauaaccauugguucggucuguaugacaauuggaauggcuaacuuaauauuacaaauuggaaacauaaucucaauauggauuagccacucaauucaacuugggaaccaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47482 - RNA, 1410 nt, Artificial Sequence; identical to SEQ ID NO: 47242
  neuraminidase__InfluenzaA__ACS27202

SEQ ID NO: 47483 - RNA, 1410 nt, Artificial Sequence; identical to SEQ ID NO: 47379
  neuraminidase__InfluenzaA__ACS27212

SEQ ID NO: 47484 - RNA, 1410 nt, Artificial Sequence; identical to SEQ ID NO: 47276
  neuraminidase__InfluenzaA__ACS27222

SEQ ID NO: 47485 - RNA, 1410 nt, Artificial Sequence; identical to SEQ ID NO: 47242
  neuraminidase__InfluenzaA__ACS27232

SEQ ID NO: 47486 - RNA, 1410 nt, Artificial Sequence; identical to SEQ ID NO: 47232
  neuraminidase__InfluenzaA__ACS27242

SEQ ID NO: 47487 - RNA, 1410 nt, Artificial Sequence; identical to SEQ ID NO: 47242
  neuraminidase__InfluenzaA__ACS27252

SEQ ID NO: 47488 - RNA, 1410 nt, Artificial Sequence
  neuraminidase__InfluenzaA__ACS27771
augaauccaaaucagaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47489 - RNA, 1410 nt, Artificial Sequence; identical to SEQ ID NO: 47397
  neuraminidase__InfluenzaA__ACS34969

SEQ ID NO: 47490 - RNA, 1410 nt, Artificial Sequence; identical to SEQ ID NO: 47397
  neuraminidase__InfluenzaA__ACS34970

SEQ ID NO: 47491 - RNA, 1410 nt, Artificial Sequence; identical to SEQ ID NO: 47397
  neuraminidase__InfluenzaA__ACS34971

SEQ ID NO: 47492 - RNA, 1410 nt, Artificial Sequence
  neuraminidase__InfluenzaA__ACS34972
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaguauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 47493 - RNA, 1410 nt, Artificial Sequence; identical to SEQ ID NO: 47242
  neuraminidase__InfluenzaA__ACS50081

SEQ ID NO: 47494 - RNA, 1410 nt, Artificial Sequence; identical to SEQ ID NO: 47445
  neuraminidase__InfluenzaA__ACS50087

SEQ ID NO: 47495 - RNA, 1410 nt, Artificial Sequence; identical to SEQ ID NO: 47242
  neuraminidase__InfluenzaA__ACS50094

SEQ ID NO: 47496 - RNA, 1410 nt, Artificial Sequence
  neuraminidase__InfluenzaA__ACS54264
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47497 - RNA, 1410 nt, Artificial Sequence; identical to SEQ ID NO: 47397
  neuraminidase__InfluenzaA__ACS54265

SEQ ID NO: 47498 - RNA, 1410 nt, Artificial Sequence; identical to SEQ ID NO: 47441
  neuraminidase__InfluenzaA__ACS54266

SEQ ID NO: 47499 - RNA, 1410 nt, Artificial Sequence; identical to SEQ ID NO: 47242
  neuraminidase__InfluenzaA__ACS54267

SEQ ID NO: 47500 - RNA, 1410 nt, Artificial Sequence; identical to SEQ ID NO: 47441
  neuraminidase__InfluenzaA__ACS54268

SEQ ID NO: 47501 - RNA, 1410 nt, Artificial Sequence; identical to SEQ ID NO: 47362
  neuraminidase__InfluenzaA__ACS54303

SEQ ID NO: 47502 - RNA, 1410 nt, Artificial Sequence; identical to SEQ ID NO: 47242
  neuraminidase__InfluenzaA__ACS68823

SEQ ID NO: 47503 - RNA, 1410 nt, Artificial Sequence; identical to SEQ ID NO: 47242
  neuraminidase__InfluenzaA__ACS75824

SEQ ID NO: 47504 - RNA, 1410 nt, Artificial Sequence; identical to SEQ ID NO: 47242
  neuraminidase__InfluenzaA__ACS77929

SEQ ID NO: 47505 - RNA, 1410 nt, Artificial Sequence; identical to SEQ ID NO: 47242
  neuraminidase__InfluenzaA__ACS77939

SEQ ID NO: 47506 - RNA, 1410 nt, Artificial Sequence; identical to SEQ ID NO: 47275
  neuraminidase__InfluenzaA__ACS77949

SEQ ID NO: 47507 - RNA, 1410 nt, Artificial Sequence; identical to SEQ ID NO: 47441
  neuraminidase__InfluenzaA__ACS77959

SEQ ID NO: 47508 - RNA, 1410 nt, Artificial Sequence; identical to SEQ ID NO: 47242
  neuraminidase__InfluenzaA__ACS77969

SEQ ID NO: 47509 - RNA, 1410 nt, Artificial Sequence; identical to SEQ ID NO: 47242
  neuraminidase__InfluenzaA__ACS77979

SEQ ID NO: 47510 - RNA, 1410 nt, Artificial Sequence; identical to SEQ ID NO: 47242
  neuraminidase__InfluenzaA__ACS77989

SEQ ID NO: 47511 - RNA, 1410 nt, Artificial Sequence; identical to SEQ ID NO: 47242
  neuraminidase__InfluenzaA__ACS77999

SEQ ID NO: 47512 - RNA, 1410 nt, Artificial Sequence
  neuraminidase__InfluenzaA__ACS78009
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauuggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47513 - RNA, 1410 nt, Artificial Sequence; identical to SEQ ID NO: 47242
  neuraminidase__InfluenzaA__ACS78019

SEQ ID NO: 47514 - RNA, 1410 nt, Artificial Sequence; identical to SEQ ID NO: 47242
  neuraminidase__InfluenzaA__ACS78039

SEQ ID NO: 47515 - RNA, 1410 nt, Artificial Sequence; identical to SEQ ID NO: 47242
  neuraminidase__InfluenzaA__ACS78049

SEQ ID NO: 47516 - RNA, 1410 nt, Artificial Sequence
  neuraminidase__InfluenzaA__ACS88274
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47517 - RNA, 1410 nt, Artificial Sequence; identical to SEQ ID NO: 47242
  neuraminidase__InfluenzaA__ACS88275

SEQ ID NO: 47518 - RNA, 1410 nt, Artificial Sequence; identical to SEQ ID NO: 47232
  neuraminidase__InfluenzaA__ACS92572

SEQ ID NO: 47519 - RNA, 1410 nt, Artificial Sequence; identical to SEQ ID NO: 47232
  neuraminidase__InfluenzaA__ACS92582

SEQ ID NO: 47520 - RNA, 1410 nt, Artificial Sequence; identical to SEQ ID NO: 47441
  neuraminidase__InfluenzaA__ACS92592

SEQ ID NO: 47521 - RNA, 1410 nt, Artificial Sequence; identical to SEQ ID NO: 47445
  neuraminidase__InfluenzaA__ACS92603

SEQ ID NO: 47522 - RNA, 1410 nt, Artificial Sequence; identical to SEQ ID NO: 47276
  neuraminidase__InfluenzaA__ACS92614

SEQ ID NO: 47523 - RNA, 1410 nt, Artificial Sequence; identical to SEQ ID NO: 47242
  neuraminidase__InfluenzaA__ACT09115

SEQ ID NO: 47524 - RNA, 1410 nt, Artificial Sequence; identical to SEQ ID NO: 47242
  neuraminidase__InfluenzaA__ACT10309

SEQ ID NO: 47525 - RNA, 1410 nt, Artificial Sequence; identical to SEQ ID NO: 47242
  neuraminidase__InfluenzaA__ACT10315

SEQ ID NO: 47526 - RNA, 1410 nt, Artificial Sequence; identical to SEQ ID NO: 47241
  neuraminidase__InfluenzaA__ACT11059

SEQ ID NO: 47527 - RNA, 1350 nt, Artificial Sequence
  neuraminidase__InfluenzaA__ACT15313
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguuaacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47528 - RNA, 1350 nt, Artificial Sequence
  neuraminidase__InfluenzaA__ACT15315
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuaugagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccaugggugucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauuguauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47529 - RNA, 1350 nt, Artificial Sequence
  neuraminidase__InfluenzaA__ACT15319
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaagauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaggagagcacaauuuggacuaguggaagcagcauaucuuuuugugguguaaauggugacacuguuaguuggucuuggccagacggugcugaguugccauucaccauugacaaguag

SEQ ID NO: 47530 - RNA, 1350 nt, Artificial Sequence
  neuraminidase__InfluenzaA__ACT15321
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagagagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacucagggagccuuacugaaugacaagcacuccaaugggacugucaaagacagaagcccucacagaacauuaaugagcuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47531 - RNA, 1350 nt, Artificial Sequence
  neuraminidase__InfluenzaA__ACT15323
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47532 - RNA, 1350 nt, Artificial Sequence
  neuraminidase__InfluenzaA__ACT15325
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggacguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47533 - RNA, 1350 nt, Artificial Sequence
  neuraminidase__InfluenzaA__ACT15327
augaauccaaaucagaagauaauaaccaucggaucaaucuguaugguaauugguauaguuagcuuaauguuacaaauugggaacaugaucucaauaugggucagucauucaauucagacagggaaucgaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuugacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuuccgguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguauaaaauaggauauauaugcaguggaauuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47534 - RNA, 1350 nt, Artificial Sequence
  neuraminidase__InfluenzaA__ACT15331
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47535 - RNA, 1350 nt, Artificial Sequence
  neuraminidase__InfluenzaA__ACT15333
augaauccaaaucagaagauaauaaccaucggaucaaucuguaugguaauuggaauaguuagcuuaauguuacaaauugggaacaugaucucaauaugggucagccauucaauucagacaggaaaucaaugccaaggugaaccaaucagcaacacuaaauuucuuacugagaaagcuguggcuucaguaacauuagcgggcaauucaucucuuuguccuauuagcgggugggcuguauacaguaaggacaacaguauaaggaucggcuccaggggagauguguuuguuauaagagagccguucaucucaugcucccacuuggaaugcagaaccuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaaucucugguccagacaauggagcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggaaugcuccuguuauccugaugcuggcgaaaucacaugugugugcagggauaauuggcaugguucaaauaggccauggguaucuuucaaucaaaauuuggaguaucaaauaggauauauaugcaguggaguuuucggagacaauccacgccccaaugauggaacagguaguugugguccaguggucucuaauggggcauaugggguaaaaggguuuucguuuaaauacggcaaugguguuuggaucgggagaaccaaaagcacuaauucuaggagcggcuuugaaaugauuugggaccccaauggguggacuggaacggacaguagcuucucggggaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47536 - RNA, 1350 nt, Artificial Sequence
  neuraminidase__InfluenzaA__ACT15335
augaauccaaaucagaagauaauaaccaucggaucaaucuguaugguaauugggauaguuagcuuaauguuacaaauugggaacaugaucucaauaugggucagucauucaauucagacagggaaucgaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuugacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuuccgguccagacaauggggcuguggcuguauugaaauacaauggcauaauaacagacaccaucaaaaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggaguguuccuguuauccugaugccggcgaaaucacaugugugugcagggauaauuggcauggaucaaauaggccauggguaucuuucaaucaaaauuuggaguauaaaauaggauauauaugcaguggaauuuucggagacaauccacgccccaaugauggaacaggcaguugugguccggugcuccccaacggggcauauggggugaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47537 - RNA, 1350 nt, Artificial Sequence
  neuraminidase__InfluenzaA__ACT15337
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaguaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47538 - RNA, 1350 nt, Artificial Sequence
  neuraminidase__InfluenzaA__ACT15341
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggacguguuuguuauaagagagccauucaucucaugcucccacuuggaaugcagaacuuucuuuuuaacccagggagccuuacugaaugacaagcacuccaaugggacugucaaagacagaagcccucacagaacauuaaugaguuguccuguaggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggagucuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47539 - RNA, 1350 nt, Artificial Sequence
  neuraminidase__InfluenzaA__ACT15344
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggagcaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucaguaaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47540 - RNA, 1350 nt, Artificial Sequence
  neuraminidase__InfluenzaA__ACT15346
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacaacauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47541 - RNA, 1350 nt, Artificial Sequence
  neuraminidase__InfluenzaA__ACT15348
augaauccaaaucagaagauaauaaccaucggaucaaucuguaugguaauuggaacaguuagcuuaauguuacaaauugggaacaugaucucaauaugggucagccauucaauucagacaggaaaucaaugccaaggugaaccaaucagcaacacuaaauuucuuacugagaaagcuguggcuucaguaacauuagcgggcaauucaucucuuuguccuauuagcggaugggcuguauacaguaaggacaacaguauaaggaucggcuccaggggagauguguuuguuauaagagagccguucaucucaugcucccacuuggaaugcagaaccuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaaucucugguccagacaauggagcuguggccguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggaaugcuccuguuauccugaugccggcgaaaucacaugugugugcagggauaauuggcaugguucaaauaggccauggguaucuuucaaucaaaauuuggaguaucaaauaggauauauaugcaguggaguuuucggagacaauccacgccccaaugaugggacagguaguugugguccaguggucucuaauggggcauaugggguaaaaggguuuucguuuaaauacggcaaugguguuuggaucgggagaaccaaaagcacuaauucuaggagcggcuuugaaaugauuugggaccccaauggguggacuggaacggacaguagcuucucggggaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47542 - RNA, 1350 nt, Artificial Sequence
  neuraminidase__InfluenzaA__ACT15350
augaauccaaaucagaagauaauaaccaucggaucaaucuguaugguaauugggauaguuagcuuaauguuacaaauugggaacaugaucucaauaugggucagucauucaauucagacagggaaucgaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuugacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuuccgguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguauaaaauaggauauauaugcaguggaauuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagaacaauuuggaccaguggaagcagcauaucuuuuugugguguaaauggugacacuguuaguuggucuuggccagacggugcugaguugccauucaccauugacaaguag

SEQ ID NO: 47543 - RNA, 1350 nt, Artificial Sequence
  neuraminidase__InfluenzaA__ACT15352
augaauccaaaucagaagauaauaaccaucggaucaaucuguaugguaauuggaauaguuagcuuaauguuacaaauugggaacaugaucucaauaugggucagccauucaauucagacaggaaaucaaugccaagaugaaccaaucagcaacacuaaauuucuuacugagaaagcuguggcuucaguaacauuagcgggcaauucaucucuuuguccuauuagcggaugggcuguauacaguaaggacaacaguauaaggaucggcuccaggggagauguguuuguuauaagagagccguucaucucaugcucccacuuggaaugcagaaccuucuuuuugacucagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaaucucugguccagacaauggagcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggaaaaggggaaagugguuaaaucagucgaauuggaugcuccuaauuaucacuaugaggaaugcuccuguuauccugaugccggcgaaaucacaugugugugcagggauaauuggcaugguucaaauaggccauggguaucuuucaaucaaaauuuggaguaucaaauaggauauauaugcaguggaguuuucggagacaauccacgucccaaugauggaacagguaguugugguccaguggucuccaauggggcauaugggguaaaaggguuuucguuuaaauacggcaaugguguuuggaucgggagaaccaaaagcacuaauucuaggagcggcuuugaaaugauuugggaccccaauggguggacuggaacggacaguagcuucucggggaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47544 - RNA, 1350 nt, Artificial Sequence
  neuraminidase__InfluenzaA__ACT15354
augaauccaagucagaagauaauaaccaucggaucaauuuguaugguaauugggauaguuagcuuaauguuacaaauugggaacaugaucucaauauggaucagucauucaauucagacagggaaucaaugccaagaugaaccaaucagcaacacuaaauuucuuacugagaaagcuguggccucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaauaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugggguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47545 - RNA, 1350 nt, Artificial Sequence
  neuraminidase__InfluenzaA__ACT15356
augaauccaaaucagaagauaauaaccaucggaucaaucuguaugguaauuggaauaguuagcuuaauguuacaaauugggaacaugaucucaauaugggucagccauucaauucagacaggaaaucaaugccaagaugaaccaaucagcaacacuaaauuucuuacugagaaagcuguggcuucaguaacauuagcgggcaauucaucucuuuguccuauuagcggaugggcuguauacaguaaggacaacaguauaaggaucggcuccaggggagauguguuuguuauaagagagccguucaucucaugcucccacuuggaaugcagaacuuucuuuuugacucagggagccuuacugaaugacaagcacuccaaugggacugucaaagacagaagcccucacagaacauuaaugaguuguccugugggugaggcucccucuccauauaacucaagguuugagucuguugcuuggucagcaagugcuugccaugauggcaccaguugguugacaauuggaaucucugguccagacaauggagcuguggcuguauugaaauacaauggcauaauaacagacaccaucaagaguuggaggaacaacauacugagaacucaagagucugaaugugcauguguaaauggcucuugcuuuacuguaaugacugauggaccaaguagugggcaggcaucauauaagaucuucaaaauggagaaggggaaagugguuaaaucagucgaauuggaugcuccuaauuaucacuaugaggaaugcuccuguuauccugaugccggcgaaaucacaugugugugcagggauaauuggcaugguucaaauaggccauggguaucuuucaaucaaaauuuggaguaucaaauaggauauauaugcaguggaguuuucggagacaauccacgccccaaugauggaacagguaguugugguccaguguucucuaauggggcauaugggguaaaaggguuuucguuuaaauacggcaaugguguuuggaucgggagaaccaaaagcacuaauucuaggagcggcuuugaaaugauuugggaccccaauggguggacuggaacggacaguagcuuuucggggaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauagugacacuguuaguuggucuuggccagacggugcugaguugccauucaccauugacaaguag

SEQ ID NO: 47546 - RNA, 1350 nt, Artificial Sequence
  neuraminidase__InfluenzaA__ACT15358
augaauccaaaucagaagauaauaaccaucggaucaaucuguaugguaauugggauaguuagcuuaauguuacaaauugggaacaugaucucaauaugggucagucauucaauucagacagggaaucgaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuugacccauggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuuccgguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggauaucuuucaaucaaaauuuggaguauaaaauaggauauauaugcaguggaauuuucggagacaauccacgccccaaugauggaacaggcaguugugguccggugcuccccaacggggcauauggggugaaaggguuuucauuuaaauacggcaaugguguuuggaucgggagaaccaaaagcacuaauuccaggagcggcuuugaaaugauuugggacccaaauggguggacuggaacggacaguagcuuuucggugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 47547 - RNA, 1410 nt, Artificial Sequence
  neuraminidase__InfluenzaA__ACT21515
augaauccaaaucaaaagauaauaacgauuggcucuguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacaggaauuggucaaagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuauugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucagggagugcccagcaugucgaggagugcuccugcuauccucgauauccuggugucagaugugucugcagggacaacuggaaaggcuccaauaggcccaucguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47548 - RNA, 1410 nt, Artificial Sequence
  neuraminidase__InfluenzaA__ACT21516
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauagcguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcguagcaugguccagcucaaguugucacgauggaaaagcauggcugcauguuuguguaacgggggaugaaaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaauuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaaaugaagucuuguggaccucaaacaguauuguuguguuuuguggaaccucagguacauauggaacaggcucauggccugauggggcggacaucaaucucaugccuauauaa

SEQ ID NO: 47549 - RNA, 1410 nt, Artificial Sequence
  neuraminidase__InfluenzaA__ACT21517
augaauccaaaucaaaagauaauaacgauuggcuccguuucucucaccauuuccacaauaugcuucuuuaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucagagccgcaaugugacauuacaggauuugcaccuuuuucuaaggacaauucgauuaggcuuuccgcugguggggacaucugggugacaagagaaccuuaugugucaugcgauccugacaaauguuaucaauuugcccuuggacagggaacaacacuaaacaacgugcauucaaaugacacaguacaugauaggaccccuuaucggacccuagugaugaaugaguuagguguuccauuucaucuggggacuaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucagaacccaggagucagaaugcguuuguaucaauggaacuuguacaguaguaaugacugaugggagugcuucaggaaaagcugauacuaaaauacuauucauugaggaggggaaaaucguucauacuagcacauugucagggagugcccagcaugucgaggagugcuccugcuauccucgauauccuggugucagaugugucugcagagacaacuggaaaggcuccaauaggcccaucguagauauaaacauaaaggauuauagcauuguuuccaguuaugugugcucaggacuugcuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47550 - RNA, 1410 nt, Artificial Sequence
  neuraminidase__InfluenzaA__ACT21574
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugaaucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47551 - RNA, 1410 nt, Artificial Sequence
  neuraminidase__InfluenzaA__ACT21585
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguguguagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 47552 - RNA, 1410 nt, Artificial Sequence; identical to SEQ ID NO: 47441
  neuraminidase__InfluenzaA__ACT22011

SEQ ID NO: 47553 - RNA, 1410 nt, Artificial Sequence; identical to SEQ ID NO: 47242
  neuraminidase__InfluenzaA__ACT22012

SEQ ID NO: 47554 - RNA, 1410 nt, Artificial Sequence; identical to SEQ ID NO: 47441
  neuraminidase__InfluenzaA__ACT22013

SEQ ID NO: 47555 - RNA, 1410 nt, Artificial Sequence; identical to SEQ ID NO: 47242
  neuraminidase__InfluenzaA__ACT22014

SEQ ID NO: 47556 - RNA, 1410 nt, Artificial Sequence; identical to SEQ ID NO: 47232
  neuraminidase__InfluenzaA__ACT22015

SEQ ID NO: 47557 - RNA, 1410 nt, Artificial Sequence
  neuraminidase__InfluenzaA__ACT22016
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47558 - RNA, 1410 nt, Artificial Sequence; identical to SEQ ID NO: 47306
  neuraminidase__InfluenzaA__ACT22017

SEQ ID NO: 47559 - RNA, 1410 nt, Artificial Sequence; identical to SEQ ID NO: 47445
  neuraminidase__InfluenzaA__ACT22018

SEQ ID NO: 47560 - RNA, 1410 nt, Artificial Sequence
  neuraminidase__InfluenzaA__ACT22506
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47561 - RNA, 1410 nt, Artificial Sequence; identical to SEQ ID NO: 47445
  neuraminidase__InfluenzaA__ACT22511

SEQ ID NO: 47562 - RNA, 1410 nt, Artificial Sequence
  neuraminidase__InfluenzaA__ACT33121
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 47563 - RNA, 1410 nt, Artificial Sequence; identical to SEQ ID NO: 47242
  neuraminidase__InfluenzaA__ACT33124

SEQ ID NO: 47564 - RNA, 1410 nt, Artificial Sequence; identical to SEQ ID NO: 47441
  neuraminidase__InfluenzaA__ACT33126

SEQ ID NO: 47565 - RNA, 1410 nt, Artificial Sequence
  neuraminidase__InfluenzaA__ACT35526
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaaacaagauaucguaggaauaaaugaguggucaggauauagugggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47566 - RNA, 1410 nt, Artificial Sequence; identical to SEQ ID NO: 47439
  neuraminidase__InfluenzaA__ACT36507

SEQ ID NO: 47567 - RNA, 1410 nt, Artificial Sequence; identical to SEQ ID NO: 47445
  neuraminidase__InfluenzaA__ACT36672

SEQ ID NO: 47568 - RNA, 1410 nt, Artificial Sequence; identical to SEQ ID NO: 47445
  neuraminidase__InfluenzaA__ACT36673

SEQ ID NO: 47569 - RNA, 1410 nt, Artificial Sequence; identical to SEQ ID NO: 47242
  neuraminidase__InfluenzaA__ACT36674

SEQ ID NO: 47570 - RNA, 1410 nt, Artificial Sequence; identical to SEQ ID NO: 47242
  neuraminidase__InfluenzaA__ACT36675

SEQ ID NO: 47571 - RNA, 1410 nt, Artificial Sequence; identical to SEQ ID NO: 47242
  neuraminidase__InfluenzaA__ACT36677

SEQ ID NO: 47572 - RNA, 1410 nt, Artificial Sequence
  neuraminidase__InfluenzaA__ACT36678
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuagacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47573 - RNA, 1410 nt, Artificial Sequence; identical to SEQ ID NO: 47232
  neuraminidase__InfluenzaA__ACT36679

SEQ ID NO: 47574 - RNA, 1410 nt, Artificial Sequence; identical to SEQ ID NO: 47242
  neuraminidase__InfluenzaA__ACT36680

SEQ ID NO: 47575 - RNA, 1410 nt, Artificial Sequence; identical to SEQ ID NO: 47241
  neuraminidase__InfluenzaA__ACT36682

SEQ ID NO: 47576 - RNA, 1410 nt, Artificial Sequence
  neuraminidase__InfluenzaA__ACT36683
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacugacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47577 - RNA, 1410 nt, Artificial Sequence; identical to SEQ ID NO: 47242
  neuraminidase__InfluenzaA__ACT36684

SEQ ID NO: 47578 - RNA, 1410 nt, Artificial Sequence; identical to SEQ ID NO: 47241
  neuraminidase__InfluenzaA__ACT36685

SEQ ID NO: 47579 - RNA, 1410 nt, Artificial Sequence; identical to SEQ ID NO: 47253
  neuraminidase__InfluenzaA__ACT36686

SEQ ID NO: 47580 - RNA, 1410 nt, Artificial Sequence; identical to SEQ ID NO: 47241
  neuraminidase__InfluenzaA__ACT36687

SEQ ID NO: 47581 - RNA, 1410 nt, Artificial Sequence
  neuraminidase__InfluenzaA__ACT36688
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauacaaauauggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47582 - RNA, 1410 nt, Artificial Sequence; identical to SEQ ID NO: 47232
  neuraminidase__InfluenzaA__ACT36689

SEQ ID NO: 47583 - RNA, 1410 nt, Artificial Sequence; identical to SEQ ID NO: 47272
  neuraminidase__InfluenzaA__ACT36690

SEQ ID NO: 47584 - RNA, 1410 nt, Artificial Sequence; identical to SEQ ID NO: 47253
  neuraminidase__InfluenzaA__ACT36691

SEQ ID NO: 47585 - RNA, 1410 nt, Artificial Sequence; identical to SEQ ID NO: 47272
  neuraminidase__InfluenzaA__ACT36693

SEQ ID NO: 47586 - RNA, 1410 nt, Artificial Sequence; identical to SEQ ID NO: 47242
  neuraminidase__InfluenzaA__ACT36694

SEQ ID NO: 47587 - RNA, 1410 nt, Artificial Sequence; identical to SEQ ID NO: 47242
  neuraminidase__InfluenzaA__ACT36695

SEQ ID NO: 47588 - RNA, 1410 nt, Artificial Sequence; identical to SEQ ID NO: 47292
  neuraminidase__InfluenzaA__ACT52684

SEQ ID NO: 47589 - RNA, 1410 nt, Artificial Sequence; identical to SEQ ID NO: 47327
  neuraminidase__InfluenzaA__ACT54608

SEQ ID NO: 47590 - RNA, 1410 nt, Artificial Sequence
  neuraminidase__InfluenzaA__ACT66157
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaaguaauggacaggccucauacaagaucuuaagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47591 - RNA, 1410 nt, Artificial Sequence; identical to SEQ ID NO: 47562
  neuraminidase__InfluenzaA__ACT67117

SEQ ID NO: 47592 - RNA, 1410 nt, Artificial Sequence; identical to SEQ ID NO: 47241
  neuraminidase__InfluenzaA__ACT67121

SEQ ID NO: 47593 - RNA, 1410 nt, Artificial Sequence; identical to SEQ ID NO: 47242
  neuraminidase__InfluenzaA__ACT67240

SEQ ID NO: 47594 - RNA, 1410 nt, Artificial Sequence
  neuraminidase__InfluenzaA__ACT67241
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaauuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47595 - RNA, 1410 nt, Artificial Sequence; identical to SEQ ID NO: 47242
  neuraminidase__InfluenzaA__ACT67243

SEQ ID NO: 47596 - RNA, 1410 nt, Artificial Sequence
  neuraminidase__InfluenzaA__ACT67256
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47597 - RNA, 1410 nt, Artificial Sequence
  neuraminidase__InfluenzaA__ACT68161
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaggcaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47598 - RNA, 1410 nt, Artificial Sequence; identical to SEQ ID NO: 47241
  neuraminidase__InfluenzaA__ACT68162

SEQ ID NO: 47599 - RNA, 1410 nt, Artificial Sequence; identical to SEQ ID NO: 47241
  neuraminidase__InfluenzaA__ACT68163

SEQ ID NO: 47600 - RNA, 1410 nt, Artificial Sequence; identical to SEQ ID NO: 47241
  neuraminidase__InfluenzaA__ACT68164

SEQ ID NO: 47601 - RNA, 1410 nt, Artificial Sequence; identical to SEQ ID NO: 47242
  neuraminidase__InfluenzaA__ACT68166

SEQ ID NO: 47602 - RNA, 1410 nt, Artificial Sequence; identical to SEQ ID NO: 47242
  neuraminidase__InfluenzaA__ACT68167

SEQ ID NO: 47603 - RNA, 1410 nt, Artificial Sequence; identical to SEQ ID NO: 47272
  neuraminidase__InfluenzaA__ACT68168

SEQ ID NO: 47604 - RNA, 1410 nt, Artificial Sequence
  neuraminidase__InfluenzaA__ACT68169
augaauccaaaccaaaagauaauaaccauugguucggucuguaugacaauuggaauggcuaacuuaauauuacaaauuggaaacauaaucucaauauggauuagccacucaauucaacuuggggaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaaugaaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggggcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaagugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47605 - RNA, 1410 nt, Artificial Sequence
  neuraminidase__InfluenzaA__ACT68171
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccuuaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguuccugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47606 - RNA, 1410 nt, Artificial Sequence
  neuraminidase__InfluenzaA__ACT68172
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguuccugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47607 - RNA, 1410 nt, Artificial Sequence
  neuraminidase__InfluenzaA__ACT68173
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47608 - RNA, 1410 nt, Artificial Sequence; identical to SEQ ID NO: 47242
  neuraminidase__InfluenzaA__ACT68174

SEQ ID NO: 47609 - RNA, 1410 nt, Artificial Sequence
  neuraminidase__InfluenzaA__ACT68175
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47610 - RNA, 1410 nt, Artificial Sequence
  neuraminidase__InfluenzaA__ACT68176
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugagaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47611 - RNA, 1410 nt, Artificial Sequence; identical to SEQ ID NO: 47242
  neuraminidase__InfluenzaA__ACT68177

SEQ ID NO: 47612 - RNA, 1410 nt, Artificial Sequence; identical to SEQ ID NO: 47242
  neuraminidase__InfluenzaA__ACT68178

SEQ ID NO: 47613 - RNA, 1410 nt, Artificial Sequence; identical to SEQ ID NO: 47609
  neuraminidase__InfluenzaA__ACT68179

SEQ ID NO: 47614 - RNA, 1410 nt, Artificial Sequence; identical to SEQ ID NO: 47242
  neuraminidase__InfluenzaA__ACT68180

SEQ ID NO: 47615 - RNA, 1410 nt, Artificial Sequence; identical to SEQ ID NO: 47272
  neuraminidase__InfluenzaA__ACT79145

SEQ ID NO: 47616 - RNA, 1410 nt, Artificial Sequence
  neuraminidase__InfluenzaA__ACT79155
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguugguggaugggcuauauacaguaaagacaacaguguaagaaucgguuccaagggggauguguuugucauaagggaaccauucauaucaugcucccucuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47617 - RNA, 1410 nt, Artificial Sequence; identical to SEQ ID NO: 47560
  neuraminidase__InfluenzaA__ACT79165

SEQ ID NO: 47618 - RNA, 1410 nt, Artificial Sequence; identical to SEQ ID NO: 47560
  neuraminidase__InfluenzaA__ACT79175

SEQ ID NO: 47619 - RNA, 1410 nt, Artificial Sequence; identical to SEQ ID NO: 47242
  neuraminidase__InfluenzaA__ACT79185

SEQ ID NO: 47620 - RNA, 1410 nt, Artificial Sequence
  neuraminidase__InfluenzaA__ACT79622
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacguccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47621 - RNA, 1410 nt, Artificial Sequence
  neuraminidase__InfluenzaA__ACT79630
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47622 - RNA, 1410 nt, Artificial Sequence; identical to SEQ ID NO: 47242
  neuraminidase__InfluenzaA__ACT83798

SEQ ID NO: 47623 - RNA, 1410 nt, Artificial Sequence; identical to SEQ ID NO: 47242
  neuraminidase__InfluenzaA__ACT83808

SEQ ID NO: 47624 - RNA, 1410 nt, Artificial Sequence; identical to SEQ ID NO: 47242
  neuraminidase__InfluenzaA__ACT83818

SEQ ID NO: 47625 - RNA, 1410 nt, Artificial Sequence; identical to SEQ ID NO: 47512
  neuraminidase__InfluenzaA__ACT83828

SEQ ID NO: 47626 - RNA, 1410 nt, Artificial Sequence; identical to SEQ ID NO: 47242
  neuraminidase__InfluenzaA__ACT83838

SEQ ID NO: 47627 - RNA, 1410 nt, Artificial Sequence; identical to SEQ ID NO: 47275
  neuraminidase__InfluenzaA__ACT83848

SEQ ID NO: 47628 - RNA, 1410 nt, Artificial Sequence; identical to SEQ ID NO: 47241
  neuraminidase__InfluenzaA__ACT83858

SEQ ID NO: 47629 - RNA, 1410 nt, Artificial Sequence; identical to SEQ ID NO: 47242
  neuraminidase__InfluenzaA__ACT83868

SEQ ID NO: 47630 - RNA, 1410 nt, Artificial Sequence; identical to SEQ ID NO: 47242
  neuraminidase__InfluenzaA__ACT83878

SEQ ID NO: 47631 - RNA, 1410 nt, Artificial Sequence; identical to SEQ ID NO: 47242
  neuraminidase__InfluenzaA__ACT86002

SEQ ID NO: 47632 - RNA, 1410 nt, Artificial Sequence; identical to SEQ ID NO: 47242
  neuraminidase__InfluenzaA__ACT86012

SEQ ID NO: 47633 - RNA, 1410 nt, Artificial Sequence; identical to SEQ ID NO: 47242
  neuraminidase__InfluenzaA__ACT86022

SEQ ID NO: 47634 - RNA, 1410 nt, Artificial Sequence; identical to SEQ ID NO: 47275
  neuraminidase__InfluenzaA__ACT86032

SEQ ID NO: 47635 - RNA, 1410 nt, Artificial Sequence; identical to SEQ ID NO: 47242
  neuraminidase__InfluenzaA__ACT86042

SEQ ID NO: 47636 - RNA, 1410 nt, Artificial Sequence; identical to SEQ ID NO: 47242
  neuraminidase__InfluenzaA__ACT86052

SEQ ID NO: 47637 - RNA, 1410 nt, Artificial Sequence; identical to SEQ ID NO: 47242
  neuraminidase__InfluenzaA__ACT86062

SEQ ID NO: 47638 - RNA, 1410 nt, Artificial Sequence; identical to SEQ ID NO: 47242
  neuraminidase__InfluenzaA__ACT86072

SEQ ID NO: 47639 - RNA, 1410 nt, Artificial Sequence; identical to SEQ ID NO: 47242
  neuraminidase__InfluenzaA__ACT86082

SEQ ID NO: 47640 - RNA, 1410 nt, Artificial Sequence; identical to SEQ ID NO: 47242
  neuraminidase__InfluenzaA__ACT86092

SEQ ID NO: 47641 - RNA, 1410 nt, Artificial Sequence
  neuraminidase__InfluenzaA__ACT86102
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguguccuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguaucagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47642 - RNA, 1410 nt, Artificial Sequence; identical to SEQ ID NO: 47242
  neuraminidase__InfluenzaA__ACT86112

SEQ ID NO: 47643 - RNA, 1410 nt, Artificial Sequence; identical to SEQ ID NO: 47512
  neuraminidase__InfluenzaA__ACT86122

SEQ ID NO: 47644 - RNA, 1410 nt, Artificial Sequence; identical to SEQ ID NO: 47242
  neuraminidase__InfluenzaA__ACT86132

SEQ ID NO: 47645 - RNA, 1410 nt, Artificial Sequence; identical to SEQ ID NO: 47242
  neuraminidase__InfluenzaA__ACT86142

SEQ ID NO: 47646 - RNA, 1410 nt, Artificial Sequence
  neuraminidase__InfluenzaA__ACT97323
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47647 - RNA, 1410 nt, Artificial Sequence; identical to SEQ ID NO: 47242
  neuraminidase__InfluenzaA__ACU00934

SEQ ID NO: 47648 - RNA, 1410 nt, Artificial Sequence; identical to SEQ ID NO: 47242
  neuraminidase__InfluenzaA__ACU00944

SEQ ID NO: 47649 - RNA, 1410 nt, Artificial Sequence
  neuraminidase__InfluenzaA__ACU00954
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47650 - RNA, 1410 nt, Artificial Sequence
  neuraminidase__InfluenzaA__ACU12497
augaauccaaaucaaaagauaauaacaauuggcucuguuucucucaccauugccacaauauguuuccuuaugcaaauugccauccugguaacuacuguaacauugcauuucaagcaauaugagugcaacucccccccaaacaaccaaguaaugccaugugaaccaacaauaauagaaagaaacauaacagagauaguguauuugacuaacaccaccauagagagggagauaugccccaaacuaguagaauacagaaauuggucaaagccgcaauguaggguuacaggauuugcaccuuuuucuaaggacaauucaauucggcuuuccgcugguggagacauuugggugacaagagaaccuuaugugucaugcgauccuggcaaguguuaucaauuugcacuaggacagggaaccacacuaaacaacaggcauucaaaugacacaguacaugauaggaccccuuaucgaacccucuugaugaaugaguuggguguuccauuucauuugggaaccaagcaagugugcauagcaugguccagcucaaguugucacgauggaaaagcauggcugcauguuugugucacugggcaugaugaaaaugcaacugcuagcuucauuuacgaugggaggcuuguagauaguauuguuucaugguccaaaaauauccucaggacccaggagucggaaugcguuuguaucaauggaacuuguacaguaguaaugacugauggaagugcuucagaaagagcugauacuaaaauacuauucauugaagaggggaaaaucguucauauuagcccauugucaggaagugcucagcauguagaggagugcuccuguuauccucgauauccuggugucagaugugucugcagagacaacuggaaaggcuccaauaggcccaucguagauauaaaugugaaagauuauagcauuguuuccaguuaugugugcucagggcuuguuggagacacacccagaaaaaacgacagcuccagcaguagcuauugccggaauccuaacaaugagaaagggagucauggagugaaaggcugggccuuugacgauggaaaugacguguggaugggaagaacgaucggcgaggaguuacgcucagguuaugaaaccuucaaagucauuggaggcugguccacaccuaacuccaaauugcagacaaauaggcaagucauaguugacagagguaauagguccgguuauucugguauuuucucuguugaaggcaaaagcugcaucaaucggugcuuuuauguagaauugauaaggggaaggaaacaggaaacuaaagucugguggaccucaaacaguauuguuguguuuuguggcaccucagguacauauggaacaggcucauggccugauggggcggacaucaaucucaugccuauauaa

SEQ ID NO: 47651 - RNA, 1413 nt, Artificial Sequence
  neuraminidase__InfluenzaA__ACU12508
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaucaaagaaucaucacauaugaaaacagcaccugggugaaucacacauauguuaauauuaacaacaccaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggugcucuauuaaaugacaaacauucaaaugggaccguaaaggacagaaguccuuauagggccuuaaugagcuguccucuaggugaagcuccuuccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugcccagagaaaauacaacaaucuggacuagugggagcagcauuucuuuuuguggcguuaauagugauacugcaaacugguccuggccagacggugcugaguugccguucaccauugacaaguag

SEQ ID NO: 47652 - RNA, 1410 nt, Artificial Sequence
  neuraminidase__InfluenzaA__ACU12519
augaauccaaaucaaaagauaauaacgauuggcucuguuucucucaccauuuccacaauaugcuucuucaugcaaauugccauucugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaauuagcagaauacagaaauuggucaaagccgcaauguaacauuacaggauuugcaccuuuuucuaaggacaauucgauucggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaauuggguguuccauuucaucuggggaccaagcaagugugcauagcaugguccagcucaaguugucacgauggaaaagcauggcugcauguuuguauaacgggggaugaugaaaaugcaacugcuagcuucauuuacaaugggaggcuuguagauaguguuguuucaugguccaaaaaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccuguuauccucgauauccuggugucagaugugucugcagagacaacuggaaaggcuccaauaggcccaucguagauauaaacauaaaggauuauagcauuguuuccagcuaugugugcucaggacuuguuggagacacacccagaaaaaacgacagcuccagcaguggccauugcuuggauccaaacaaugaagaagguggucauggagugaaaggcugggccuuugaugauggaaaugacguauggaugggaagaacgaucagcgagaaguuacgcucaggauaugaaaccuucaaagucauugaaggcugguccaauccuaacuccaaauugcagauaaauaggcaagucauaguugacagagguaauagguccgguuauucugguauuuucucuguugaaggcaaaagcugcaucaaucggugcuuuuauguggaguugauaaggggaagaaaccaggaaacugaagucuuguggaccucaaacaguauuguuguguuuuguggcaccucagguacauauggaacaggcucauggccugauggggcggacaucaaucucaugccuauauaa

SEQ ID NO: 47653 - RNA, 1410 nt, Artificial Sequence
  neuraminidase__InfluenzaA__ACU12530
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacggggaaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccaguuaugugugcucaggacuuguuggagacacacccagaaaaaacgacagcuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47654 - RNA, 1410 nt, Artificial Sequence
  neuraminidase__InfluenzaA__ACU12541
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuucuaguuaugugugcucaggacuuguuggagacacacccagaaaaaacgacaguuccagcaguagccauugcuuggauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauggcagauaaauaggcaagucauaguugacagagguaauagauccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47655 - RNA, 1410 nt, Artificial Sequence
  neuraminidase__InfluenzaA__ACU12552
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacaugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauaguagauauaaacauaaaggauuauagcauuguuuccgguuaugugugcucaggacuuguuggagacacacccagaaaaaacgacagcuccagcaguagccauugcucggauccuaacaaugaagaagguggucauggagugaaaggcugggccuuugaugaugggaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47656 - RNA, 1413 nt, Artificial Sequence
  neuraminidase__InfluenzaA__ACU12574
augaacccaaaucaaaagauaauaaccauuggaucaaucaguauagcaaucggaauaauuaaucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuuuauaucauguucucacuuggaaugcagaaccuuuuuucugacccaaggugcucuauuaaaugacaaacauucaaaugggaccguaaaagacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacgggguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagggaaaauacaacaaucuggacuagugggagcagcauuuccuuuuguggcguuaauagugauacugcaaacuggucuuggccagacggugcugaguugccguucaccauugacaaguag

SEQ ID NO: 47657 - RNA, 1413 nt, Artificial Sequence
  neuraminidase__InfluenzaA__ACU12585
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaucaaagaaucaucacauaugaaaacagcaccugggugaaucacacauauguuaauauuaacaacaccaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccuuccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugcccagagaaaauacaacaaucuggacuagugggagcagcauuucuuuuugugguguuaauagugauacugcaaacugguccuggccagacggugcugaguugccguucaccauugacaaguag

SEQ ID NO: 47658 - RNA, 1413 nt, Artificial Sequence
  neuraminidase__InfluenzaA__ACU12596
augaacccaaaucaaaagauaauaaccauuggaucaaucaguauagcaaucggaauaauuagucuaauguugcaaauaggaaguauuauuucaauaugggcuagucacucaauccgaacuggaagucaaaacaacacuggaauaugcaaccaaagaaucaucacauaugaaaacagcaccugggugaaucacacauauguuaauauuaacaacacuaauguuguugcuggagaggacaaaaagucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcguccugaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47659 - RNA, 1410 nt, Artificial Sequence
  neuraminidase__InfluenzaA__ACU13077
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaaacaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47660 - RNA, 1410 nt, Artificial Sequence; identical to SEQ ID NO: 47242
  neuraminidase__InfluenzaA__ACU13078

SEQ ID NO: 47661 - RNA, 1410 nt, Artificial Sequence; identical to SEQ ID NO: 47242
  neuraminidase__InfluenzaA__ACU13079

SEQ ID NO: 47662 - RNA, 1410 nt, Artificial Sequence; identical to SEQ ID NO: 47242
  neuraminidase__InfluenzaA__ACU13080

SEQ ID NO: 47663 - RNA, 1410 nt, Artificial Sequence; identical to SEQ ID NO: 47241
  neuraminidase__InfluenzaA__ACU13081

SEQ ID NO: 47664 - RNA, 1410 nt, Artificial Sequence; identical to SEQ ID NO: 47242
  neuraminidase__InfluenzaA__ACU13082

SEQ ID NO: 47665 - RNA, 1410 nt, Artificial Sequence; identical to SEQ ID NO: 47242
  neuraminidase__InfluenzaA__ACU13083

SEQ ID NO: 47666 - RNA, 1410 nt, Artificial Sequence
  neuraminidase__InfluenzaA__ACU13084
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47667 - RNA, 1410 nt, Artificial Sequence; identical to SEQ ID NO: 47242
  neuraminidase__InfluenzaA__ACU16799

SEQ ID NO: 47668 - RNA, 1410 nt, Artificial Sequence
  neuraminidase__InfluenzaA__ACU16861
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacugaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47669 - RNA, 1410 nt, Artificial Sequence; identical to SEQ ID NO: 47242
  neuraminidase__InfluenzaA__ACU16934

SEQ ID NO: 47670 - RNA, 1410 nt, Artificial Sequence; identical to SEQ ID NO: 47439
  neuraminidase__InfluenzaA__ACU16997

SEQ ID NO: 47671 - RNA, 1410 nt, Artificial Sequence; identical to SEQ ID NO: 47242
  neuraminidase__InfluenzaA__ACU17130

SEQ ID NO: 47672 - RNA, 1410 nt, Artificial Sequence; identical to SEQ ID NO: 47242
  neuraminidase__InfluenzaA__ACU17191

SEQ ID NO: 47673 - RNA, 1410 nt, Artificial Sequence
  neuraminidase__InfluenzaA__ACU17262
augaauccaaaccaaaagauaauaaccauugguucggucuguaugacaauuggaauggcuaacuuaauauuacaaauuggaaacauaaucucaauauggauuagccacucaauucaacuugggaaucaaagucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47674 - RNA, 1410 nt, Artificial Sequence; identical to SEQ ID NO: 47242
  neuraminidase__InfluenzaA__ACU17325

SEQ ID NO: 47675 - RNA, 1410 nt, Artificial Sequence; identical to SEQ ID NO: 47242
  neuraminidase__InfluenzaA__ACU17393

SEQ ID NO: 47676 - RNA, 1410 nt, Artificial Sequence; identical to SEQ ID NO: 47242
  neuraminidase__InfluenzaA__ACU17454

SEQ ID NO: 47677 - RNA, 1410 nt, Artificial Sequence; identical to SEQ ID NO: 47242
  neuraminidase__InfluenzaA__ACU17524

SEQ ID NO: 47678 - RNA, 1410 nt, Artificial Sequence
  neuraminidase__InfluenzaA__ACU27043
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47679 - RNA, 1413 nt, Artificial Sequence
  neuraminidase__InfluenzaA__ACU27415
augaacccaaaucaaaagauuauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuugccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagcugccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47680 - RNA, 1413 nt, Artificial Sequence
  neuraminidase__InfluenzaA__ACU27416
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuugccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccauccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagcugccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47681 - RNA, 1410 nt, Artificial Sequence; identical to SEQ ID NO: 47241
  neuraminidase__InfluenzaA__ACU29961

SEQ ID NO: 47682 - RNA, 1410 nt, Artificial Sequence
  neuraminidase__InfluenzaA__ACU29971
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggucagacggugcugaguugccauuuaccauugacaaguaa

SEQ ID NO: 47683 - RNA, 1410 nt, Artificial Sequence; identical to SEQ ID NO: 47242
  neuraminidase__InfluenzaA__ACU29981

SEQ ID NO: 47684 - RNA, 1410 nt, Artificial Sequence; identical to SEQ ID NO: 47242
  neuraminidase__InfluenzaA__ACU29991

SEQ ID NO: 47685 - RNA, 1410 nt, Artificial Sequence; identical to SEQ ID NO: 47242
  neuraminidase__InfluenzaA__ACU30001

SEQ ID NO: 47686 - RNA, 1410 nt, Artificial Sequence
  neuraminidase__InfluenzaA__ACU30021
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaacauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47687 - RNA, 1410 nt, Artificial Sequence
  neuraminidase__InfluenzaA__ACU30085
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaaugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47688 - RNA, 1410 nt, Artificial Sequence
  neuraminidase__InfluenzaA__ACU30095
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47689 - RNA, 1410 nt, Artificial Sequence
  neuraminidase__InfluenzaA__ACU30105
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 47690 - RNA, 1410 nt, Artificial Sequence; identical to SEQ ID NO: 47242
  neuraminidase__InfluenzaA__ACU30114

SEQ ID NO: 47691 - RNA, 1410 nt, Artificial Sequence; identical to SEQ ID NO: 47242
  neuraminidase__InfluenzaA__ACU30123

SEQ ID NO: 47692 - RNA, 1410 nt, Artificial Sequence
  neuraminidase__InfluenzaA__ACU31177
augaauccaaaccaaaagauaauaaccauugguucggucuguaugacaauuggaauggcuaacuuaauauuacaaauuggaaacauaaucucaauauggauuagccacuuaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaguuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47693 - RNA, 1410 nt, Artificial Sequence; identical to SEQ ID NO: 47242
  neuraminidase__InfluenzaA__ACU31178

SEQ ID NO: 47694 - RNA, 1410 nt, Artificial Sequence; identical to SEQ ID NO: 47253
  neuraminidase__InfluenzaA__ACU31179

SEQ ID NO: 47695 - RNA, 1410 nt, Artificial Sequence; identical to SEQ ID NO: 47253
  neuraminidase__InfluenzaA__ACU31180

SEQ ID NO: 47696 - RNA, 1410 nt, Artificial Sequence; identical to SEQ ID NO: 47241
  neuraminidase__InfluenzaA__ACU31181

SEQ ID NO: 47697 - RNA, 1410 nt, Artificial Sequence; identical to SEQ ID NO: 47242
  neuraminidase__InfluenzaA__ACU31182

SEQ ID NO: 47698 - RNA, 1410 nt, Artificial Sequence; identical to SEQ ID NO: 47272
  neuraminidase__InfluenzaA__ACU31183

SEQ ID NO: 47699 - RNA, 1410 nt, Artificial Sequence; identical to SEQ ID NO: 47445
  neuraminidase__InfluenzaA__ACU31184

SEQ ID NO: 47700 - RNA, 1410 nt, Artificial Sequence; identical to SEQ ID NO: 47606
  neuraminidase__InfluenzaA__ACU31185

SEQ ID NO: 47701 - RNA, 1410 nt, Artificial Sequence; identical to SEQ ID NO: 47606
  neuraminidase__InfluenzaA__ACU31186

SEQ ID NO: 47702 - RNA, 1410 nt, Artificial Sequence; identical to SEQ ID NO: 47606
  neuraminidase__InfluenzaA__ACU31187

SEQ ID NO: 47703 - RNA, 1410 nt, Artificial Sequence; identical to SEQ ID NO: 47253
  neuraminidase__InfluenzaA__ACU31188

SEQ ID NO: 47704 - RNA, 1350 nt, Artificial Sequence
  neuraminidase__InfluenzaA__ACU46645
augaauccaaauaagaagauaauaaccaucggaucaaucuguaugguaacuggaaugguuagcuuaauguuacaaauugggaacuugaucucaauaugggucagucauucaauucacacagggaaucaacacaaagcugaaccaaucagcaauacuaaucuucuuacugagaaaacuguggcuucaguaaaauuagcgggcaauucaucucuuugccccauuaauggaugggcuguauacaguaaggacaacaguauaaggaucgguuccaagggggauguguuuguuauaagagagccauucaucucaugcucccacuuggaaugcagaacuuucuuuuugacucagggagccuugcugaaugacaagcacuccaaugggacugucaaagacagaaguccucacagaacauuaaugagugguccugugggugaggcucccuccccauacaacucaagguuugaguauguugcuuggucagcaagugcuugccaugaucgcaccaguagauugacaauuggaauuucuggcccagacaauggggcuguggcuguauugaaauacaauggcauaauaacagacacuaucaagaguuggaggaauaacauacugagaacucaagagucugaaugugcauguguaaauggcucuugcuuuacuguaaugacugacggaccaaguaauggucaggcaucacauaagaucuucaaaauggaaaaaggaaaagugguuaaaucagucgaauuggaugcucccaauuaucacuaugaggaaugcuccuguuauccugaugccggcgaaaucacaugugugugcagggauaauuggcauggcucaaaucggccauggguaucuuucaaucaaaauuuggaguaucaaauaggauauauaugcaguggaguuuucggagacaauccacgccccaaugauggagcagguaguugugguccgguguccucuaacggggcauaugggguaaaaggguuuucauuuaaauacggcaauggugucuggaucgggagaacaaaaagcacuaauuccaggagcggcuuugaaaugauuugggauccaaauggguggacugaaacggacaguagcuuuucagugaaacaagauaucguagcaauaacugauuggucaggauauagcgggaguuuuguccagcauccagaacugacaggacuagauugcauaagaccuuguuucuggguugaguugaucagagggcggcccaaagagagcacaauuuggacuagugggagcagcauaucuuuuugugguguaaauagugacacuguggguuggucuuggccagacggugcugaguugccauucaccauugacaaguag

SEQ ID NO: 47705 - RNA, 1410 nt, Artificial Sequence
  neuraminidase__InfluenzaA__ACU56927
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagauaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47706 - RNA, 1410 nt, Artificial Sequence
  neuraminidase__InfluenzaA__ACU56934
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47707 - RNA, 1410 nt, Artificial Sequence
  neuraminidase__InfluenzaA__ACU64791
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 47708 - RNA, 1410 nt, Artificial Sequence
  neuraminidase__InfluenzaA__ACU64811
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuagcgggcaauuccucucucugcccuguuaguggaugggcuauauacaguaaagacaacaguguaagaaucgguuccaagggggauguguuuaucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugcuccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 47709 - RNA, 1410 nt, Artificial Sequence; identical to SEQ ID NO: 47008
  neuraminidase__InfluenzaA__ACU79885

SEQ ID NO: 47710 - RNA, 1410 nt, Artificial Sequence
  neuraminidase__InfluenzaA__ACU79896
augaauccaaaucaaaagauaauaacaauuggcucugucucucucaccauugcaacaguaugcuuccucaugcagauugccauccugguaacuacuguaacauugcauuuuaagcaauaugagugcgacucccccgcgagcaaccaaguaaugccgugugaaccaauaauaauagaaaggaacauaacagagauaguguauuugaauaacaccaccauagagaaagagauaugccccaaaguaguggaauacagaaauuggucaaagccgcaaugucaaauuacaggauuugcaccuuuuucuaaggacaauucaauccggcuuucugcugguggggacauuugggugacgagagaaccuuaugugucaugcgaucauggcaaguguuaucaauuugcacucgggcaggggaccacacuagacaacaaacauucaaaugacacaauacaugauagaaucccucaucgaacccuauuaaugaaugaguuggguguuccauuucauuuaggaaccaggcaaguguguauagcaugguccagcucaaguugucacgauggaaaagcauggcugcauguuuguaucacuggggaugacaaaaaugcaacugcuagcuucauuuaugacgggaggcuuguggacaguauugguucauggucccaaaauauccucagaacccaggagucggaaugcguuuguaucaaugggacuugcacaguaguaaugacugauggaagugcuucaggaagagccgauacuagaauacuauucauugaagaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucagggcuuguuggcgacacaccuagaaacgacgacagaucuagcaauagcaauugcaggaauccuaacaaugagagagggaaucaaggagugaaaggcugggccuuugacaauggagaugacguguggaugggaagaacgaucagcaaggauuuacgcucagguuaugaaacuuucaaagucauuggugguugguccacaccuaauuccaaaucgcagaucaauagacaagucauaguugacagcgauaaucggucagguuacucugguauuuucucuguugagggcaaaagcugcaucaauaggugcuuuuauguggaguugauaaggggaaggaaacaggagacuagagugugguggaccucaaacaguauuguuguguuuuguggcacuucagguaccuauggaacaggcucauggccugauggggcgaacaucaauuucaugccuauauaa

SEQ ID NO: 47711 - RNA, 1410 nt, Artificial Sequence; identical to SEQ ID NO: 44599
  neuraminidase__InfluenzaA__ACU79918

SEQ ID NO: 47712 - RNA, 1410 nt, Artificial Sequence; identical to SEQ ID NO: 44611
  neuraminidase__InfluenzaA__ACU79929

SEQ ID NO: 47713 - RNA, 1413 nt, Artificial Sequence
  neuraminidase__InfluenzaA__ACU79940
augaauccaaaucaaaaaauaauaaccauuggaucaaucaguauaguaaucgggauaauuagucuaauguugcaaauaggaaauauuauuucaauaugggcuagucacucaauccaaacuggaagucaaaaccacacuggaauaugcaaccaaagaaucaucacauaugaaaauagcaccugggugaaucacacauauguuaauauuaacaacacuaauguuguugcuggaaaggacaaaacuucagugacauuggccggcaauucaucacuuuguucuaucaguggaugggcuauauacacaaaagacaacagcauaagaauugguuccaaaggagauguuuuugucauaagagagccuuuuauaucauguucucacuuggaaugcagaaccuuuuuucugacccaaggugcucuauuaaaugacaaacauucaaaugggaccguuaaggacagaaguccuuauagggccuuaaugagcuguccucuaggcgaagcuccgucuccauauaauucaaaguuugaaucaguugcuuggucagcaagcgcaugucaugauggcaugggcugguuaacaaucggaauuucugguccagauaauggagcaguggcuguacuaaaauacaacggcauaauaacugaaaccauaaaaaguuggaaaaagcgaauauuaagaacacaagagucugaaugugucugugugaacgggucauguuuuaccauaaugaccgauggcccgaguaauggggccgccucguacaaaaucuucaagauugagaaggggaagguuacuaaaucaauagaguugaaugcacccaauucucauuaugaggaauguuccuguuacccagacacuggcacagugauguguguaugcagggacaauuggcacgguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacagauaugguaaugguguuuggauaggaaggacuaaaaguaacagacucagaaagggauuugagaugauuugggauccuaauggauggacagauaccgacagugauuucucagugaaacaggauguuguggcaaugacugauuggucaggguacagcggaaguuucguucaacauccugagcuaacaggauuggacuguauaagaccuugcuucuggguugaauuagucagaggacggccuagagaaaauacaacaaucuggacuagugggagcagcauuucuuuuuguggcguaaauagugauacugcaaacuggucuuggccagacggugcugaguugccauucaccauugacaaguag

SEQ ID NO: 47714 - RNA, 1410 nt, Artificial Sequence
  neuraminidase__InfluenzaA__ACU79951
augaauccaaaucaaaagauaauaacaauuggcucugucucucucaccauugaaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguuggcaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 47715 - RNA, 1410 nt, Artificial Sequence; identical to SEQ ID NO: 47107
  neuraminidase__InfluenzaA__ACU79973

SEQ ID NO: 47716 - RNA, 1413 nt, Artificial Sequence
  neuraminidase__InfluenzaA__ACU79984
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47717 - RNA, 1410 nt, Artificial Sequence
  neuraminidase__InfluenzaA__ACU80006
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaagaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47718 - RNA, 1410 nt, Artificial Sequence
  neuraminidase__InfluenzaA__ACU80017
augaauacaaaucaaagaauaauaaccauugggacaaucugucuaauaguuggaauaauuagucuauuauugcagauaggaaauauaaucuuguuauggaugagccauucaauucagacuggagaaaaaagccauccuaagguaugcaaccaaagugucauuaccuaugaaaacaacacaugggugaaccagacuuauguaaacauuagcaauaccaauauugcugcuggacagggugugacuccaauaauacuagccggcaauuccucucuuugcccaaucagugggugggcuauauacagcaaagacaauagcauaaggauugguuccaaaggagacauuuuugucaugagagagccauucauuucaugcucucacuuggaaugcagaaccuuuuuucugacccaaggcgcuuugcugaaugacaggcauucuaauggaaccgucaaggacaggaguccuuauagaaccuuaaugagcugccccaucggugaagcuccaucuccguacaauucaagguucgaaucaguugcuuggucagcaagugcaugccaugauggaaugggauggcuaacaaucgggauuuccgguccagauaauggagcaguggcuguuuuaaaauacaaugguauaauaacagauacaauaaaaaguuggagaaacaaaauauuaagaacacaagagucugaauguguuuguauaaacgguucguguuuuacuauaaugacugacggcccaagcaaugggcaagccucguacaaauuauucaaaauggagaaagggaagauuauuaggucaauugagcuggaugcaccuaauuaccacuaugaggaaugcuccuguuacccugauacaggcaaaguggugugugugugcagagacaauuggcaugcuucgaaucgaccaugggucucuuucgaucagaaucuugauuaucaaauaggguacauaugcagugggguuuucggugauaauccgcguucuaaugaugggaaaggcaauuguggcccaguacuuucuaauggagcaaauggagugaagggguuuucauuuagauauggcaaugguguuuggauaggaagaacuaaaaguaucagcucuagaaguggauuugagaugauuugggauccuaauggauggacagaaacugauaguaguuucucuaugaagcaagauauuauagcauuaacugauuggucgggauacaguggaaguuuuguccaacauccugaauuaacaggaaugaacugcauaaggccuuguuucuggguagaguuaaucagagggcaacccaaggagagcacaaucuggacuaguggaagcagcauuucuuucuguggcgugaacaguggcacugcaagcuggucauggccagacggagcugaucugccauucaccauugacaaguag

SEQ ID NO: 47719 - RNA, 1413 nt, Artificial Sequence
  neuraminidase__InfluenzaA__ACU80028
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47720 - RNA, 1410 nt, Artificial Sequence; identical to SEQ ID NO: 47103
  neuraminidase__InfluenzaA__ACU80039

SEQ ID NO: 47721 - RNA, 1413 nt, Artificial Sequence; identical to SEQ ID NO: 47220
  neuraminidase__InfluenzaA__ACU80050

SEQ ID NO: 47722 - RNA, 1410 nt, Artificial Sequence; identical to SEQ ID NO: 47653
  neuraminidase__InfluenzaA__ACU80061

SEQ ID NO: 47723 - RNA, 1413 nt, Artificial Sequence; identical to SEQ ID NO: 47161
  neuraminidase__InfluenzaA__ACU80072

SEQ ID NO: 47724 - RNA, 1413 nt, Artificial Sequence; identical to SEQ ID NO: 47236
  neuraminidase__InfluenzaA__ACU80094

SEQ ID NO: 47725 - RNA, 1410 nt, Artificial Sequence
  neuraminidase__InfluenzaA__ACU80105
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacaggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47726 - RNA, 1410 nt, Artificial Sequence; identical to SEQ ID NO: 47219
  neuraminidase__InfluenzaA__ACU80127

SEQ ID NO: 47727 - RNA, 1410 nt, Artificial Sequence; identical to SEQ ID NO: 47219
  neuraminidase__InfluenzaA__ACU80138

SEQ ID NO: 47728 - RNA, 1410 nt, Artificial Sequence; identical to SEQ ID NO: 47103
  neuraminidase__InfluenzaA__ACU80160

SEQ ID NO: 47729 - RNA, 1413 nt, Artificial Sequence; identical to SEQ ID NO: 47719
  neuraminidase__InfluenzaA__ACU80171

SEQ ID NO: 47730 - RNA, 1410 nt, Artificial Sequence
  neuraminidase__InfluenzaA__ACU80182
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggauaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47731 - RNA, 1410 nt, Artificial Sequence
  neuraminidase__InfluenzaA__ACU80193
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauucucaggacccaggagucagagugcgucuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47732 - RNA, 1410 nt, Artificial Sequence; identical to SEQ ID NO: 47018
  neuraminidase__InfluenzaA__ACU80204

SEQ ID NO: 47733 - RNA, 1413 nt, Artificial Sequence
  neuraminidase__InfluenzaA__ACU80237
augaacccaaaucaaaagauaauaaccauuggaucaaucaguauagcaaucggaauaauuagucuaauguugcaaauaggaaauauuauuucaauaugggcuagucacucaauccaaacuggaaaucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucgaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47734 - RNA, 1410 nt, Artificial Sequence; identical to SEQ ID NO: 47107
  neuraminidase__InfluenzaA__ACU80248

SEQ ID NO: 47735 - RNA, 1410 nt, Artificial Sequence; identical to SEQ ID NO: 47219
  neuraminidase__InfluenzaA__ACU80259

SEQ ID NO: 47736 - RNA, 1413 nt, Artificial Sequence
  neuraminidase__InfluenzaA__ACU80270
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuagcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggauuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacaguggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47737 - RNA, 1413 nt, Artificial Sequence
  neuraminidase__InfluenzaA__ACU80281
augaaccaaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47738 - RNA, 1410 nt, Artificial Sequence
  neuraminidase__InfluenzaA__ACU80303
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaaggugguaauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47739 - RNA, 1410 nt, Artificial Sequence
  neuraminidase__InfluenzaA__ACU80314
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacaggggacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47740 - RNA, 1410 nt, Artificial Sequence; identical to SEQ ID NO: 47725
  neuraminidase__InfluenzaA__ACU80325

SEQ ID NO: 47741 - RNA, 1410 nt, Artificial Sequence
  neuraminidase__InfluenzaA__ACU80336
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaccggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47742 - RNA, 1410 nt, Artificial Sequence
  neuraminidase__InfluenzaA__ACU80347
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagggguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47743 - RNA, 1410 nt, Artificial Sequence; identical to SEQ ID NO: 47219
  neuraminidase__InfluenzaA__ACU80358

SEQ ID NO: 47744 - RNA, 1410 nt, Artificial Sequence; identical to SEQ ID NO: 47219
  neuraminidase__InfluenzaA__ACU80369

SEQ ID NO: 47745 - RNA, 1410 nt, Artificial Sequence; identical to SEQ ID NO: 47107
  neuraminidase__InfluenzaA__ACU80380

SEQ ID NO: 47746 - RNA, 1410 nt, Artificial Sequence
  neuraminidase__InfluenzaA__ACU80391
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaucauagagaaggaaauaugccccaaacuagcagaauacagaaauuggucaaagccucaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47747 - RNA, 1410 nt, Artificial Sequence; identical to SEQ ID NO: 47741
  neuraminidase__InfluenzaA__ACU80402

SEQ ID NO: 47748 - RNA, 1413 nt, Artificial Sequence
  neuraminidase__InfluenzaA__ACU80413
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuuuauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucgguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaauuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47749 - RNA, 1410 nt, Artificial Sequence; identical to SEQ ID NO: 47107
  neuraminidase__InfluenzaA__ACU80427

SEQ ID NO: 47750 - RNA, 1410 nt, Artificial Sequence; identical to SEQ ID NO: 47107
  neuraminidase__InfluenzaA__ACU80438

SEQ ID NO: 47751 - RNA, 1410 nt, Artificial Sequence
  neuraminidase__InfluenzaA__ACU80461
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugagaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47752 - RNA, 1410 nt, Artificial Sequence
  neuraminidase__InfluenzaA__ACU80603
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauga

SEQ ID NO: 47753 - RNA, 1410 nt, Artificial Sequence; identical to SEQ ID NO: 47107
  neuraminidase__InfluenzaA__ACU80614

SEQ ID NO: 47754 - RNA, 1410 nt, Artificial Sequence; identical to SEQ ID NO: 47725
  neuraminidase__InfluenzaA__ACU80625

SEQ ID NO: 47755 - RNA, 1410 nt, Artificial Sequence
  neuraminidase__InfluenzaA__ACU80636
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucaacaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47756 - RNA, 1410 nt, Artificial Sequence
  neuraminidase__InfluenzaA__ACU80647
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47757 - RNA, 1410 nt, Artificial Sequence
  neuraminidase__InfluenzaA__ACU80658
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaaaaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47758 - RNA, 1410 nt, Artificial Sequence; identical to SEQ ID NO: 47018
  neuraminidase__InfluenzaA__ACU80669

SEQ ID NO: 47759 - RNA, 1410 nt, Artificial Sequence; identical to SEQ ID NO: 47103
  neuraminidase__InfluenzaA__ACU80691

SEQ ID NO: 47760 - RNA, 1410 nt, Artificial Sequence; identical to SEQ ID NO: 47219
  neuraminidase__InfluenzaA__ACU80702

SEQ ID NO: 47761 - RNA, 1410 nt, Artificial Sequence
  neuraminidase__InfluenzaA__ACU80713
augaauccaaaucaaaagauaauaacgauuggcucuguuucucucaccauuuccacaauaugcuucuucaugcaaauugccaucuugauaacuacuguaacauugcauuucaagcaauaugaauucaacuccuccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagucugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaccauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaauccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47762 - RNA, 1410 nt, Artificial Sequence
  neuraminidase__InfluenzaA__ACU80724
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47763 - RNA, 1410 nt, Artificial Sequence
  neuraminidase__InfluenzaA__ACU80735
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcacaucagguacauauggaacaggcucauggccugauggggcggacaucaaucucaugccuauauaa

SEQ ID NO: 47764 - RNA, 1410 nt, Artificial Sequence; identical to SEQ ID NO: 47751
  neuraminidase__InfluenzaA__ACU80746

SEQ ID NO: 47765 - RNA, 1410 nt, Artificial Sequence
  neuraminidase__InfluenzaA__ACU80757
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagguaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacacaguacgugauaggaccccuuaucggacccuauugaugaaugaguuagguguuccuuuucaucuggggaccaagcaagugugcauagcauggucaagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47766 - RNA, 1410 nt, Artificial Sequence
  neuraminidase__InfluenzaA__ACU80768
augaauccaaaucaaaagauaauaacgauuggcucuguuucucucaccauuuccacaauaugcuucuucaugcaaacugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccucggacagggaacaacacuaaacaacgugcauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguauuguuucaugguccaaagaaauucucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacaaucagcgagaagucacgcuuaggguaugaaaccuucaaagucauugaaggcugguccaacccuaaguccaaauugcagauaaauaggcaagucauaguugacagaggugauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47767 - RNA, 1410 nt, Artificial Sequence; identical to SEQ ID NO: 47103
  neuraminidase__InfluenzaA__ACU80779

SEQ ID NO: 47768 - RNA, 1410 nt, Artificial Sequence; identical to SEQ ID NO: 47018
  neuraminidase__InfluenzaA__ACU80790

SEQ ID NO: 47769 - RNA, 1410 nt, Artificial Sequence; identical to SEQ ID NO: 47103
  neuraminidase__InfluenzaA__ACU80801

SEQ ID NO: 47770 - RNA, 1410 nt, Artificial Sequence
  neuraminidase__InfluenzaA__ACU81106
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauaguuccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47771 - RNA, 1410 nt, Artificial Sequence; identical to SEQ ID NO: 47397
  neuraminidase__InfluenzaA__ACU87265

SEQ ID NO: 47772 - RNA, 1410 nt, Artificial Sequence; identical to SEQ ID NO: 47439
  neuraminidase__InfluenzaA__ACU87273

SEQ ID NO: 47773 - RNA, 1410 nt, Artificial Sequence; identical to SEQ ID NO: 47242
  neuraminidase__InfluenzaA__ACV04231

SEQ ID NO: 47774 - RNA, 1410 nt, Artificial Sequence; identical to SEQ ID NO: 47242
  neuraminidase__InfluenzaA__ACV04241

SEQ ID NO: 47775 - RNA, 1410 nt, Artificial Sequence; identical to SEQ ID NO: 47242
  neuraminidase__InfluenzaA__ACV04251

SEQ ID NO: 47776 - RNA, 1410 nt, Artificial Sequence; identical to SEQ ID NO: 47242
  neuraminidase__InfluenzaA__ACV04261

SEQ ID NO: 47777 - RNA, 1410 nt, Artificial Sequence; identical to SEQ ID NO: 47512
  neuraminidase__InfluenzaA__ACV04271

SEQ ID NO: 47778 - RNA, 1410 nt, Artificial Sequence
  neuraminidase__InfluenzaA__ACV04281
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucggcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47779 - RNA, 1410 nt, Artificial Sequence; identical to SEQ ID NO: 47242
  neuraminidase__InfluenzaA__ACV04291

SEQ ID NO: 47780 - RNA, 1410 nt, Artificial Sequence; identical to SEQ ID NO: 47242
  neuraminidase__InfluenzaA__ACV04301

SEQ ID NO: 47781 - RNA, 1410 nt, Artificial Sequence; identical to SEQ ID NO: 47242
  neuraminidase__InfluenzaA__ACV04321

SEQ ID NO: 47782 - RNA, 1410 nt, Artificial Sequence; identical to SEQ ID NO: 47242
  neuraminidase__InfluenzaA__ACV04331

SEQ ID NO: 47783 - RNA, 1410 nt, Artificial Sequence; identical to SEQ ID NO: 47242
  neuraminidase__InfluenzaA__ACV04341

SEQ ID NO: 47784 - RNA, 1410 nt, Artificial Sequence; identical to SEQ ID NO: 47242
  neuraminidase__InfluenzaA__ACV04351

SEQ ID NO: 47785 - RNA, 1410 nt, Artificial Sequence; identical to SEQ ID NO: 47242
  neuraminidase__InfluenzaA__ACV04361

SEQ ID NO: 47786 - RNA, 1410 nt, Artificial Sequence; identical to SEQ ID NO: 47242
  neuraminidase__InfluenzaA__ACV04371

SEQ ID NO: 47787 - RNA, 1410 nt, Artificial Sequence; identical to SEQ ID NO: 47242
  neuraminidase__InfluenzaA__ACV04381

SEQ ID NO: 47788 - RNA, 1410 nt, Artificial Sequence; identical to SEQ ID NO: 47242
  neuraminidase__InfluenzaA__ACV04391

SEQ ID NO: 47789 - RNA, 1410 nt, Artificial Sequence; identical to SEQ ID NO: 47439
  neuraminidase__InfluenzaA__ACV04401

SEQ ID NO: 47790 - RNA, 1410 nt, Artificial Sequence; identical to SEQ ID NO: 47241
  neuraminidase__InfluenzaA__ACV04411

SEQ ID NO: 47791 - RNA, 1410 nt, Artificial Sequence; identical to SEQ ID NO: 47242
  neuraminidase__InfluenzaA__ACV04492

SEQ ID NO: 47792 - RNA, 1410 nt, Artificial Sequence; identical to SEQ ID NO: 47242
  neuraminidase__InfluenzaA__ACV04502

SEQ ID NO: 47793 - RNA, 1410 nt, Artificial Sequence; identical to SEQ ID NO: 47241
  neuraminidase__InfluenzaA__ACV04512

SEQ ID NO: 47794 - RNA, 1410 nt, Artificial Sequence
  neuraminidase__InfluenzaA__ACV04522
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggaaagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugcguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47795 - RNA, 1410 nt, Artificial Sequence; identical to SEQ ID NO: 47242
  neuraminidase__InfluenzaA__ACV04532

SEQ ID NO: 47796 - RNA, 1410 nt, Artificial Sequence
  neuraminidase__InfluenzaA__ACV04542
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggccaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47797 - RNA, 1410 nt, Artificial Sequence
  neuraminidase__InfluenzaA__ACV04552
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaauuacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47798 - RNA, 1410 nt, Artificial Sequence; identical to SEQ ID NO: 47242
  neuraminidase__InfluenzaA__ACV04562

SEQ ID NO: 47799 - RNA, 1410 nt, Artificial Sequence; identical to SEQ ID NO: 47275
  neuraminidase__InfluenzaA__ACV04572

SEQ ID NO: 47800 - RNA, 1410 nt, Artificial Sequence; identical to SEQ ID NO: 47242
  neuraminidase__InfluenzaA__ACV04582

SEQ ID NO: 47801 - RNA, 1410 nt, Artificial Sequence
  neuraminidase__InfluenzaA__ACV04758
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47802 - RNA, 1410 nt, Artificial Sequence
  neuraminidase__InfluenzaA__ACV33087
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggagacccaaagagaacacaaucuggacuagcgggagcagcauauccuuuugugguguaaacagugacacuguggguuggucuuggccagacggugcugaguugccauuuaccauugacaaguaa

SEQ ID NO: 47803 - RNA, 1410 nt, Artificial Sequence; identical to SEQ ID NO: 47242
  neuraminidase__InfluenzaA__ACV33107

SEQ ID NO: 47804 - RNA, 1410 nt, Artificial Sequence; identical to SEQ ID NO: 47242
  neuraminidase__InfluenzaA__ACV33117

SEQ ID NO: 47805 - RNA, 1410 nt, Artificial Sequence; identical to SEQ ID NO: 47242
  neuraminidase__InfluenzaA__ACV33127

SEQ ID NO: 47806 - RNA, 1410 nt, Artificial Sequence; identical to SEQ ID NO: 47242
  neuraminidase__InfluenzaA__ACV33137

SEQ ID NO: 47807 - RNA, 1410 nt, Artificial Sequence; identical to SEQ ID NO: 47242
  neuraminidase__InfluenzaA__ACV33147

SEQ ID NO: 47808 - RNA, 1410 nt, Artificial Sequence
  neuraminidase__InfluenzaA__ACV33157
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuguuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47809 - RNA, 1410 nt, Artificial Sequence
  neuraminidase__InfluenzaA__ACV33167
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggauuggucuuggccagacggugcugaguugccauuuaccauugacaaguaa

SEQ ID NO: 47810 - RNA, 1410 nt, Artificial Sequence; identical to SEQ ID NO: 47242
  neuraminidase__InfluenzaA__ACV33177

SEQ ID NO: 47811 - RNA, 1410 nt, Artificial Sequence
  neuraminidase__InfluenzaA__ACV41993
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaauaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47812 - RNA, 1410 nt, Artificial Sequence; identical to SEQ ID NO: 47242
  neuraminidase__InfluenzaA__ACV42010

SEQ ID NO: 47813 - RNA, 1410 nt, Artificial Sequence; identical to SEQ ID NO: 47242
  neuraminidase__InfluenzaA__ACV42020

SEQ ID NO: 47814 - RNA, 1410 nt, Artificial Sequence; identical to SEQ ID NO: 47008
  neuraminidase__InfluenzaA__ACV49504

SEQ ID NO: 47815 - RNA, 1362 nt, Artificial Sequence
  neuraminidase__InfluenzaA__ACV49537
augaauccaaaccagaaaauaauaaccauugggucaaucuguaugguagucggaauaauuagccuaauauugcaaauagggaauauaaucucaauauggauuagccauucaauucaaaccggaaaucaaaaccauacuggaauaugcaaccaaggcaucauuaccuauaacguuguugcugggcaggacucaacuucagugauauuaaccggcaauucaucucuuugucccauccgugggugggcuauacacagcaaagacaauggcauaagaauugguuccaaaggagacguuuuugucauaagagagccuuuuauuucauguucucacuuggaaugcaggaccuuuuuucugacucaaggcgccuuacugaaugacaagcauucaaauggggccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggagcaguggcuguauuaaaauacaacggcauaauaacugaaaccauaaaaaguuggaggaagaaaauauugagaacacaagagucugaauguaccuguguaaaugguucauguuuuaccauaaugaccgauggcccaagugaugggcuggccucguacaaaauuuucaagaucgagaaggggaagguuacuaaaucaauagaguugaaugcaccuaauucucacuacgaggaauguuccuguuacccugauaccggcaaagugaugugugugugcagagacaauuggcacgguucgaaccgaccauggguguccuucgaccaaaaccuagauuaucaaauaggauacaucugcagugggguuuucggugacaacccgcgucccaaagauggaacaggcagcuguggcccagugucugcugauggagcaaacggaguaaagggauuuucauauagguaugguaaugguguuuggauaggaaggacuaaaagugacaguuccagacauggguuugagaugauuugggauccuaauggauggacagagacugauaguagguucucugugagacaagauguuguggcaaugacugaucggucaggguacagcggaaguuucguucaacauccugagcuaacagggcuagacuguaugaggccuugcuucuggguugaauuaaucaggggacgaccugaggagaaaacaaucuggacuagugggagcaucauuucuuuuuguggcgugaauagugauacuguagauuggucuuggccagacggugcugaguugccguucaccauugacaaguag

SEQ ID NO: 47816 - RNA, 1362 nt, Artificial Sequence
  neuraminidase__InfluenzaA__ACV49559
augaauccaaaucagaaaauaauaaccauugggucaaucuguaugguagucggaauaauuagccuaauauugcaaauagggaauauaaucucaauauggauuagccauucaauucaagcugggaguagcaccugggugaaucaaacauauguuaauauuagcaacacuaacguugucgcuggacaggacgcaacuucagugauauuaaccggcaauucaucucuuugucccauccgugggugggcuauauacagcaaagacaauggcauaagaauugguuccaaaggagacauuuuugucauaagagagccuuuuauuucauguucucacuuggaaugcagggccuuuuuucugacucaaggcgccuuacugaaugacaagcauucaaaugggaccguuaaggacagaagcccuuauagggccuuaaugagcugcccugucggugaagcuccguccccguacaauucaagguuugaaucgguugcuuggucagcaagugcaugucaugauggcaugggcuggcuaacaaucggaauuucugguccagauaauggggcaguggcuguauuaaaauacaacggcauaauaacugaaaccauaaaaaguuggaggaagaaaauauugagaacacaagagucugaaugugccuguguaaaugguucauguuuuacuauaaugaccgauggcccaagugaugggccggccucguacaaaauuuucaagaucgagaaggggaagguuacuaaaucaauagaguuggaugcaccuaacucucacuacgaggaguguuccuguuacccugauaccggcaaagugaugugugugugcagagacaauuggcacgguucgaaccgaccaugggugucuuucgaucaaaaccuggauuaucaaauaggauacaucugcagugggguuuucggugacacuccgcgucccaaagauggaacaggcagcugugguccagugucuguugauggagcaaacggagugaagggauuuucauauagguauggugaugguguuuggauaggaaggacuaaaagucaaaguuccagacauggguuugagaugauuugggauccuaauggauggacagagacugauaguagguucucugugagacaagauguuguggcaauaacugauuggucaggguacagcggaaguuucguucaacauccugagcuaacagggcuagacuguaugaggccuugcuucuggguugaauuaaucagggggcaaccuaaagagaaaacaaucuggacuagugggagcagcauuucuuuuuguggcgugaauagugauacuguagacuggucuuggccagacggugcugaguugccauucaccauugacaaguag

SEQ ID NO: 47817 - RNA, 1395 nt, Artificial Sequence
  neuraminidase__InfluenzaA__ACV49570
augaauccaaaucagaaaauaauaaccauuggaucaaucuguaugguagucggaauaauuagccuaauauugcaaauagggaauauugucucaauauggauuagccauucaauucaaacuggaaaucaaaaccauacuggaacuugcgaccaaagcaucauuaccuauaaaaauagcaccuggguaaaucaaacauaugucaacguuguugcugggaaggauacaacuucagugauauuagccggcaauucaucucuuugcccuauccgugggugggcuauauacagcaaagauaauggcguaagaauugguuccaaaggagauguuuuugucauaagagaacccuuuauuucauguucucacuuggaaugcaggaccuuuuuucugacccaaggcgcccuguugaaugacaagcauucaaaugggaccguuaaggacagaagcccuuauagggccuuaaugagcugcccuguuggugaagcuccguccccguacaacucaagguuugaaucgguugcuuggucagcaagugcaugucaugauggcaugggcuggcuaacaaucggaauuucugguccagaugauggagcaguggcuguguuaaaauacaacggcauaauaacugaaaccauaaaaaguuggaggaaggaaauauugagaacacaagagucugaaugugucugcguaaaugguucauguuucacuauaaugaccgacggcccgaguggugggccggccucguacaaaauuuucaagaucgagaaggggaagguuacuaaaucaauagaguuggaugcaccuaauucucacuacgaggaauguuccuguuacccugauaccagcaaagugaugugugugugcagagacaauuggcacgguucgaaccgaccaugggugucuuucgaucaaaaucuggauuaucaaaugggauacaucugcagugggguuuucggugacaauccgcgucccaaagauggaaaaggcagcugugguccaguguauguugauggagcaaacggaguaaagggauuuucauacaaguaugguaaugguguuuggauagggaggacuaaaaguaacaguuccagacagggguucgagaugauuugggauccuaauggguggacagagacugauaguaauuucuuuacgaaacaagauguaguggcaguaaccgauuggucaggguacagcggaaguuucguucaacauccugagcuaacagggcuggacuguaugaggccuugcuucuggguugaauuaaucaggggacgaccuaaagaaaauacaaucuggaccagugggagcagcauuucuuuuuguggugugaauagugauacuguagauuggucuuggccagacggugccgaguugccauucaccauugacaaguag

SEQ ID NO: 47818 - RNA, 1410 nt, Artificial Sequence; identical to SEQ ID NO: 46908
  neuraminidase__InfluenzaA__ACV49581

SEQ ID NO: 47819 - RNA, 1410 nt, Artificial Sequence; identical to SEQ ID NO: 46908
  neuraminidase__InfluenzaA__ACV49592

SEQ ID NO: 47820 - RNA, 1410 nt, Artificial Sequence
  neuraminidase__InfluenzaA__ACV49603
augaauccaaaucaaaagauaauaacaauuggcucugucucucucaccauugaaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagagaaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 47821 - RNA, 1410 nt, Artificial Sequence
  neuraminidase__InfluenzaA__ACV49625
augaauccaaaucaaaagacaauaacaauuggcucugucucucucaccauugaaacaguaugcuuccucaugcagauugccauccuggcaacuacugugacauugcauuuuaagcaacaugagugcgacucccccgcgagcaaccaaguaaugccaugugaaccaauaauaauagaaaggaacauaacagagauaguguauuugaauaacaccaccauagagaaagagauuugccccgaaguaguggaauacagaaauuggucaaagccgcaaugucaaauuacaggauuugcaccuuuuucuaaggacaauucaauccggcuuucugcugguggggacauuugggugacgagaggaccuuaugugucaugcgauccuggcaaguguuaucaauuugcacucgggcaggggaccacacuagacaacaaacauucaaauggcacaauacaugauagaaucccucaucgaacccuauuaaugaaugaguuggguguuccauuucauuuaggaaccaaacaaguguguguagcaugguccagcucaaguugucacgauggaaaagcaugguugcauguuugugucacuggggaugauagaaaugcaacugcuagcuucauuuaugacgggaggcuuguggacaguauugguucauggucucaaaauauccucaggacccaggagucggaaugcguuuguaucaaugggacuugcacaguaguaaugacugauggaagugcaucaggaagagccgauacuagaauacuauucauuaaagaggggaaaauuguccauauuagcccauugucaggaagugcucagcauauagaggaguguuccuguuacccucgauauccugacgucagauguaucugcagagacaacuggaaaggcucuaauaggcccguuauagacauaaauauggaagauuauagcauugauuccaguuaugugugcucagggcuuguuggcgacacacccaggaacgacgacagcucuagcaauagcaauugcagggauccuaacaaugagagagggaauccaggagugaaaggcugggccuuugacaauggagaugauguauggaugggaagaacaaucagcaaagauucacgcucagguuaugaaacuuucaaagucauuggugguugguccacaccuaauuccaaaucgcaggucaauagacaggucauaguugacaacaauaauuggucugguuacucugguauuuucucuguugagggcaaaagcugcaucaauaggugcuuuuauguggaguugauaaggggaaggccacaggagacuagaguaugguggaccucaaacaguauuguuguguuuuguggcacuucagguacuuauggaacaggcucauggccugauggggcgaacaucaauuucaugccuauauaa

SEQ ID NO: 47822 - RNA, 1410 nt, Artificial Sequence; identical to SEQ ID NO: 46960
  neuraminidase__InfluenzaA__ACV49647

SEQ ID NO: 47823 - RNA, 1413 nt, Artificial Sequence
  neuraminidase__InfluenzaA__ACV49669
augaauccaaaucagaaaauaauaaccauaggaucaaucuguauggcaauaggaauaauuagucuaauauugcaaauaggaaauauuguuucaauauggaucagccacucaauccaaacgggaagucaaaacuacacuggaauaugcaaccaaagaaucauuaccuaugaaaauagcaccuggguaaaucaaacauauguuaauaucaacaacacuaauguuguugcuggacaggacacaacuucagugacauuagccggcaauucaucucuuuguccuaucagugggugggcuauauacagcaaagacaacagcauaagaauugguuccaaaggagauguuuuugucauaagagaaccuuuuauaucauguucucacuuggaaugcagaaccuuuuuucugacccaaggugcucuauuaaaugacaagcauucaaauggaaccguuaaggacagaagcccuuauagggccuuaaugagcuguccuauaggugaagcuccgucucccuacaauucaagauuugaaucaguugcuuggucagcaagcgcaugucaugauggcaugggcuggcuaacaaucggaauuucugguccagaugauggagcaguggcuguacuaaaauacaacgguauaauaacugaaaccauaaaaaguuggaggaagcgaauauuaagaacacaagagucugaaugugucuguguaaacgguucauguuuuaccauaaugaccgauggcccgaauaaugggccugccucguacaaaaucuucaaaaucgagaaggggaagauuacuaaaucaauagaguuggaugcacccaauucucauuacgaggaauguuccuguuacccagacgccggcacagugaugugugugugcagagacaauuggcaugguucgaaucgacccugggugucuuuuaaucaaaaccuggauuaucaaauaggauacaucugcagugguguuuuuggugacaauccgcgucccaaagauggaaaaggcagcugugguccaguaacuguugauggagcagacggaguaaagggguuuucauacagguaugguaaugguguuuggauaggaaggacuaaaaguaacagcuccagaagaggauuugagaugauuugggacccuaauggauggacagauaccgauaguaaauucuuagugaaacaggauguaguggcaaugacugauuggucaggguacagcggaagcuucguucaacauccugaacuaacaggauuggauuguaugaggccuugcuucuggguugaauugaucagaggacgaccuagagaaaauacaacaaucuggacuagugggagcagcauuucuuuuuguggcgugaauggugauacugcaaauuggucuuggccagacggugccgaguugccauucaccauugacaaguag

SEQ ID NO: 47824 - RNA, 1413 nt, Artificial Sequence
  neuraminidase__InfluenzaA__ACV49679
augaacccaaaucaaaagauaauaaccauuggaucaaucaguauagcaaucggaauaauuagucuaauguugcaaauaggaaguauuauuucaauaugggcuagucacucaauccgaacuggaagucaaaacaacacuggaauaugcaaccaaagaaucauaacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47825 - RNA, 1410 nt, Artificial Sequence
  neuraminidase__InfluenzaA__ACV53442
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47826 - RNA, 1410 nt, Artificial Sequence; identical to SEQ ID NO: 47621
  neuraminidase__InfluenzaA__ACV53452

SEQ ID NO: 47827 - RNA, 1410 nt, Artificial Sequence; identical to SEQ ID NO: 47305
  neuraminidase__InfluenzaA__ACV53462

SEQ ID NO: 47828 - RNA, 1410 nt, Artificial Sequence; identical to SEQ ID NO: 47242
  neuraminidase__InfluenzaA__ACV53472

SEQ ID NO: 47829 - RNA, 1410 nt, Artificial Sequence
  neuraminidase__InfluenzaA__ACV53482
augaauccaaaccaaaagauaauuaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugcgacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47830 - RNA, 1410 nt, Artificial Sequence
  neuraminidase__InfluenzaA__ACV53492
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaggcaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugagacagacaauaacuucuuaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47831 - RNA, 1410 nt, Artificial Sequence
  neuraminidase__InfluenzaA__ACV53502
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaggcaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucuuaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47832 - RNA, 1410 nt, Artificial Sequence
  neuraminidase__InfluenzaA__ACV53891
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaaaauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugugauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47833 - RNA, 1410 nt, Artificial Sequence
  neuraminidase__InfluenzaA__ACV53901
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcaggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47834 - RNA, 1410 nt, Artificial Sequence; identical to SEQ ID NO: 47242
  neuraminidase__InfluenzaA__ACV53911

SEQ ID NO: 47835 - RNA, 1410 nt, Artificial Sequence
  neuraminidase__InfluenzaA__ACV67088
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucuuucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47836 - RNA, 1410 nt, Artificial Sequence
  neuraminidase__InfluenzaA__ACV67168
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaggggaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47837 - RNA, 1410 nt, Artificial Sequence; identical to SEQ ID NO: 47241
  neuraminidase__InfluenzaA__ACV67169

SEQ ID NO: 47838 - RNA, 1410 nt, Artificial Sequence
  neuraminidase__InfluenzaA__ACV67171
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucucccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggaggacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47839 - RNA, 1410 nt, Artificial Sequence; identical to SEQ ID NO: 47242
  neuraminidase__InfluenzaA__ACV67172

SEQ ID NO: 47840 - RNA, 1410 nt, Artificial Sequence; identical to SEQ ID NO: 47272
  neuraminidase__InfluenzaA__ACV67173

SEQ ID NO: 47841 - RNA, 1410 nt, Artificial Sequence; identical to SEQ ID NO: 47275
  neuraminidase__InfluenzaA__ACV67174

SEQ ID NO: 47842 - RNA, 1410 nt, Artificial Sequence
  neuraminidase__InfluenzaA__ACV67175
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggaucaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47843 - RNA, 1410 nt, Artificial Sequence; identical to SEQ ID NO: 47439
  neuraminidase__InfluenzaA__ACV67176

SEQ ID NO: 47844 - RNA, 1410 nt, Artificial Sequence; identical to SEQ ID NO: 47253
  neuraminidase__InfluenzaA__ACV67177

SEQ ID NO: 47845 - RNA, 1410 nt, Artificial Sequence; identical to SEQ ID NO: 47242
  neuraminidase__InfluenzaA__ACV67178

SEQ ID NO: 47846 - RNA, 1410 nt, Artificial Sequence; identical to SEQ ID NO: 47242
  neuraminidase__InfluenzaA__ACV67179

SEQ ID NO: 47847 - RNA, 1410 nt, Artificial Sequence
  neuraminidase__InfluenzaA__ACV67180
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagccagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47848 - RNA, 1410 nt, Artificial Sequence
  neuraminidase__InfluenzaA__ACV67181
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuaucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauaaucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47849 - RNA, 1410 nt, Artificial Sequence; identical to SEQ ID NO: 47666
  neuraminidase__InfluenzaA__ACV67182

SEQ ID NO: 47850 - RNA, 1410 nt, Artificial Sequence
  neuraminidase__InfluenzaA__ACV67183
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuaaugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47851 - RNA, 1410 nt, Artificial Sequence; identical to SEQ ID NO: 47242
  neuraminidase__InfluenzaA__ACV67184

SEQ ID NO: 47852 - RNA, 1410 nt, Artificial Sequence
  neuraminidase__InfluenzaA__ACV67186
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguagcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47853 - RNA, 1410 nt, Artificial Sequence; identical to SEQ ID NO: 47242
  neuraminidase__InfluenzaA__ACV67187

SEQ ID NO: 47854 - RNA, 1410 nt, Artificial Sequence; identical to SEQ ID NO: 47445
  neuraminidase__InfluenzaA__ACV67188

SEQ ID NO: 47855 - RNA, 1410 nt, Artificial Sequence; identical to SEQ ID NO: 47272
  neuraminidase__InfluenzaA__ACV67189

SEQ ID NO: 47856 - RNA, 1410 nt, Artificial Sequence
  neuraminidase__InfluenzaA__ACV67190
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47857 - RNA, 1410 nt, Artificial Sequence; identical to SEQ ID NO: 47241
  neuraminidase__InfluenzaA__ACV67191

SEQ ID NO: 47858 - RNA, 1410 nt, Artificial Sequence; identical to SEQ ID NO: 47272
  neuraminidase__InfluenzaA__ACV67192

SEQ ID NO: 47859 - RNA, 1410 nt, Artificial Sequence; identical to SEQ ID NO: 47272
  neuraminidase__InfluenzaA__ACV67193

SEQ ID NO: 47860 - RNA, 1410 nt, Artificial Sequence; identical to SEQ ID NO: 47242
  neuraminidase__InfluenzaA__ACV67194

SEQ ID NO: 47861 - RNA, 1410 nt, Artificial Sequence; identical to SEQ ID NO: 47242
  neuraminidase__InfluenzaA__ACV67195

SEQ ID NO: 47862 - RNA, 1410 nt, Artificial Sequence; identical to SEQ ID NO: 47562
  neuraminidase__InfluenzaA__ACV67196

SEQ ID NO: 47863 - RNA, 1410 nt, Artificial Sequence; identical to SEQ ID NO: 47241
  neuraminidase__InfluenzaA__ACV67197

SEQ ID NO: 47864 - RNA, 1410 nt, Artificial Sequence; identical to SEQ ID NO: 47253
  neuraminidase__InfluenzaA__ACV67199

SEQ ID NO: 47865 - RNA, 1410 nt, Artificial Sequence
  neuraminidase__InfluenzaA__ACV67200
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaacggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47866 - RNA, 1410 nt, Artificial Sequence; identical to SEQ ID NO: 47241
  neuraminidase__InfluenzaA__ACV67201

SEQ ID NO: 47867 - RNA, 1410 nt, Artificial Sequence; identical to SEQ ID NO: 47241
  neuraminidase__InfluenzaA__ACV67202

SEQ ID NO: 47868 - RNA, 1410 nt, Artificial Sequence; identical to SEQ ID NO: 47445
  neuraminidase__InfluenzaA__ACV67203

SEQ ID NO: 47869 - RNA, 1410 nt, Artificial Sequence; identical to SEQ ID NO: 47242
  neuraminidase__InfluenzaA__ACV67204

SEQ ID NO: 47870 - RNA, 1410 nt, Artificial Sequence; identical to SEQ ID NO: 47242
  neuraminidase__InfluenzaA__ACV67205

SEQ ID NO: 47871 - RNA, 1410 nt, Artificial Sequence
  neuraminidase__InfluenzaA__ACV67206
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 47872 - RNA, 1410 nt, Artificial Sequence
  neuraminidase__InfluenzaA__ACV67207
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47873 - RNA, 1410 nt, Artificial Sequence
  neuraminidase__InfluenzaA__ACV67208
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgcacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47874 - RNA, 1410 nt, Artificial Sequence; identical to SEQ ID NO: 47305
  neuraminidase__InfluenzaA__ACV67210

SEQ ID NO: 47875 - RNA, 1410 nt, Artificial Sequence; identical to SEQ ID NO: 47242
  neuraminidase__InfluenzaA__ACV67211

SEQ ID NO: 47876 - RNA, 1410 nt, Artificial Sequence; identical to SEQ ID NO: 47445
  neuraminidase__InfluenzaA__ACV70076

SEQ ID NO: 47877 - RNA, 1410 nt, Artificial Sequence
  neuraminidase__InfluenzaA__ACV70086
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47878 - RNA, 1410 nt, Artificial Sequence
  neuraminidase__InfluenzaA__ACV70096
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuuacugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47879 - RNA, 1410 nt, Artificial Sequence; identical to SEQ ID NO: 47445
  neuraminidase__InfluenzaA__ACV70106

SEQ ID NO: 47880 - RNA, 1410 nt, Artificial Sequence; identical to SEQ ID NO: 47445
  neuraminidase__InfluenzaA__ACV70116

SEQ ID NO: 47881 - RNA, 1410 nt, Artificial Sequence; identical to SEQ ID NO: 47445
  neuraminidase__InfluenzaA__ACV70126

SEQ ID NO: 47882 - RNA, 1410 nt, Artificial Sequence; identical to SEQ ID NO: 47445
  neuraminidase__InfluenzaA__ACV70157

SEQ ID NO: 47883 - RNA, 1410 nt, Artificial Sequence; identical to SEQ ID NO: 47241
  neuraminidase__InfluenzaA__ACV70167

SEQ ID NO: 47884 - RNA, 1410 nt, Artificial Sequence; identical to SEQ ID NO: 47445
  neuraminidase__InfluenzaA__ACV70177

SEQ ID NO: 47885 - RNA, 1410 nt, Artificial Sequence; identical to SEQ ID NO: 47445
  neuraminidase__InfluenzaA__ACV70187

SEQ ID NO: 47886 - RNA, 1410 nt, Artificial Sequence; identical to SEQ ID NO: 47445
  neuraminidase__InfluenzaA__ACV70197

SEQ ID NO: 47887 - RNA, 1410 nt, Artificial Sequence; identical to SEQ ID NO: 47445
  neuraminidase__InfluenzaA__ACV70207

SEQ ID NO: 47888 - RNA, 1410 nt, Artificial Sequence
  neuraminidase__InfluenzaA__ACV70217
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauaugucaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccacuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47889 - RNA, 1410 nt, Artificial Sequence; identical to SEQ ID NO: 47445
  neuraminidase__InfluenzaA__ACV70227

SEQ ID NO: 47890 - RNA, 1410 nt, Artificial Sequence; identical to SEQ ID NO: 47445
  neuraminidase__InfluenzaA__ACV70237

SEQ ID NO: 47891 - RNA, 1410 nt, Artificial Sequence; identical to SEQ ID NO: 47445
  neuraminidase__InfluenzaA__ACV70247

SEQ ID NO: 47892 - RNA, 1410 nt, Artificial Sequence; identical to SEQ ID NO: 47445
  neuraminidase__InfluenzaA__ACV70257

SEQ ID NO: 47893 - RNA, 1410 nt, Artificial Sequence; identical to SEQ ID NO: 47445
  neuraminidase__InfluenzaA__ACV70267

SEQ ID NO: 47894 - RNA, 1410 nt, Artificial Sequence; identical to SEQ ID NO: 47445
  neuraminidase__InfluenzaA__ACV70277

SEQ ID NO: 47895 - RNA, 1410 nt, Artificial Sequence; identical to SEQ ID NO: 47445
  neuraminidase__InfluenzaA__ACV70287

SEQ ID NO: 47896 - RNA, 1410 nt, Artificial Sequence; identical to SEQ ID NO: 47445
  neuraminidase__InfluenzaA__ACV70297

SEQ ID NO: 47897 - RNA, 1410 nt, Artificial Sequence; identical to SEQ ID NO: 47445
  neuraminidase__InfluenzaA__ACV70307

SEQ ID NO: 47898 - RNA, 1410 nt, Artificial Sequence; identical to SEQ ID NO: 47241
  neuraminidase__InfluenzaA__ACV70317

SEQ ID NO: 47899 - RNA, 1410 nt, Artificial Sequence; identical to SEQ ID NO: 47445
  neuraminidase__InfluenzaA__ACV70327

SEQ ID NO: 47900 - RNA, 1410 nt, Artificial Sequence; identical to SEQ ID NO: 47445
  neuraminidase__InfluenzaA__ACV70337

SEQ ID NO: 47901 - RNA, 1410 nt, Artificial Sequence; identical to SEQ ID NO: 47445
  neuraminidase__InfluenzaA__ACV70347

SEQ ID NO: 47902 - RNA, 1410 nt, Artificial Sequence; identical to SEQ ID NO: 47445
  neuraminidase__InfluenzaA__ACV70357

SEQ ID NO: 47903 - RNA, 1410 nt, Artificial Sequence; identical to SEQ ID NO: 47445
  neuraminidase__InfluenzaA__ACV70367

SEQ ID NO: 47904 - RNA, 1410 nt, Artificial Sequence; identical to SEQ ID NO: 47445
  neuraminidase__InfluenzaA__ACV70377

SEQ ID NO: 47905 - RNA, 1410 nt, Artificial Sequence; identical to SEQ ID NO: 47445
  neuraminidase__InfluenzaA__ACV70387

SEQ ID NO: 47906 - RNA, 1410 nt, Artificial Sequence; identical to SEQ ID NO: 47445
  neuraminidase__InfluenzaA__ACV70397

SEQ ID NO: 47907 - RNA, 1410 nt, Artificial Sequence; identical to SEQ ID NO: 47445
  neuraminidase__InfluenzaA__ACV70407

SEQ ID NO: 47908 - RNA, 1410 nt, Artificial Sequence
  neuraminidase__InfluenzaA__ACV70417
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuuggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47909 - RNA, 1410 nt, Artificial Sequence; identical to SEQ ID NO: 47445
  neuraminidase__InfluenzaA__ACV70427

SEQ ID NO: 47910 - RNA, 1410 nt, Artificial Sequence; identical to SEQ ID NO: 47445
  neuraminidase__InfluenzaA__ACV70437

SEQ ID NO: 47911 - RNA, 1410 nt, Artificial Sequence; identical to SEQ ID NO: 47445
  neuraminidase__InfluenzaA__ACV70447

SEQ ID NO: 47912 - RNA, 1410 nt, Artificial Sequence; identical to SEQ ID NO: 47445
  neuraminidase__InfluenzaA__ACV70457

SEQ ID NO: 47913 - RNA, 1410 nt, Artificial Sequence; identical to SEQ ID NO: 47445
  neuraminidase__InfluenzaA__ACV70467

SEQ ID NO: 47914 - RNA, 1410 nt, Artificial Sequence; identical to SEQ ID NO: 47445
  neuraminidase__InfluenzaA__ACV70477

SEQ ID NO: 47915 - RNA, 1410 nt, Artificial Sequence; identical to SEQ ID NO: 47445
  neuraminidase__InfluenzaA__ACV70487

SEQ ID NO: 47916 - RNA, 1410 nt, Artificial Sequence; identical to SEQ ID NO: 47445
  neuraminidase__InfluenzaA__ACV70497

SEQ ID NO: 47917 - RNA, 1410 nt, Artificial Sequence; identical to SEQ ID NO: 47445
  neuraminidase__InfluenzaA__ACV70507

SEQ ID NO: 47918 - RNA, 1410 nt, Artificial Sequence; identical to SEQ ID NO: 47445
  neuraminidase__InfluenzaA__ACV70517

SEQ ID NO: 47919 - RNA, 1410 nt, Artificial Sequence; identical to SEQ ID NO: 47445
  neuraminidase__InfluenzaA__ACV70527

SEQ ID NO: 47920 - RNA, 1410 nt, Artificial Sequence; identical to SEQ ID NO: 47445
  neuraminidase__InfluenzaA__ACV70547

SEQ ID NO: 47921 - RNA, 1410 nt, Artificial Sequence; identical to SEQ ID NO: 47445
  neuraminidase__InfluenzaA__ACV70557

SEQ ID NO: 47922 - RNA, 1410 nt, Artificial Sequence; identical to SEQ ID NO: 47445
  neuraminidase__InfluenzaA__ACV70567

SEQ ID NO: 47923 - RNA, 1410 nt, Artificial Sequence; identical to SEQ ID NO: 47445
  neuraminidase__InfluenzaA__ACV70577

SEQ ID NO: 47924 - RNA, 1410 nt, Artificial Sequence; identical to SEQ ID NO: 47445
  neuraminidase__InfluenzaA__ACV70587

SEQ ID NO: 47925 - RNA, 1410 nt, Artificial Sequence
  neuraminidase__InfluenzaA__ACV70597
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47926 - RNA, 1410 nt, Artificial Sequence; identical to SEQ ID NO: 47445
  neuraminidase__InfluenzaA__ACV70607

SEQ ID NO: 47927 - RNA, 1410 nt, Artificial Sequence
  neuraminidase__InfluenzaA__ACV70617
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47928 - RNA, 1410 nt, Artificial Sequence; identical to SEQ ID NO: 47445
  neuraminidase__InfluenzaA__ACV70647

SEQ ID NO: 47929 - RNA, 1410 nt, Artificial Sequence; identical to SEQ ID NO: 47445
  neuraminidase__InfluenzaA__ACV70657

SEQ ID NO: 47930 - RNA, 1410 nt, Artificial Sequence; identical to SEQ ID NO: 47445
  neuraminidase__InfluenzaA__ACV70667

SEQ ID NO: 47931 - RNA, 1410 nt, Artificial Sequence; identical to SEQ ID NO: 47445
  neuraminidase__InfluenzaA__ACV70677

SEQ ID NO: 47932 - RNA, 1410 nt, Artificial Sequence; identical to SEQ ID NO: 47445
  neuraminidase__InfluenzaA__ACV70687

SEQ ID NO: 47933 - RNA, 1410 nt, Artificial Sequence; identical to SEQ ID NO: 47445
  neuraminidase__InfluenzaA__ACV70697

SEQ ID NO: 47934 - RNA, 1410 nt, Artificial Sequence
  neuraminidase__InfluenzaA__ACV70707
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacgguauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47935 - RNA, 1410 nt, Artificial Sequence; identical to SEQ ID NO: 47445
  neuraminidase__InfluenzaA__ACV70717

SEQ ID NO: 47936 - RNA, 1410 nt, Artificial Sequence; identical to SEQ ID NO: 47445
  neuraminidase__InfluenzaA__ACV70727

SEQ ID NO: 47937 - RNA, 1410 nt, Artificial Sequence; identical to SEQ ID NO: 47242
  neuraminidase__InfluenzaA__ACV70737

SEQ ID NO: 47938 - RNA, 1410 nt, Artificial Sequence; identical to SEQ ID NO: 47445
  neuraminidase__InfluenzaA__ACV70757

SEQ ID NO: 47939 - RNA, 1410 nt, Artificial Sequence; identical to SEQ ID NO: 47445
  neuraminidase__InfluenzaA__ACV70767

SEQ ID NO: 47940 - RNA, 1410 nt, Artificial Sequence
  neuraminidase__InfluenzaA__ACV70777
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaauaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47941 - RNA, 1410 nt, Artificial Sequence
  neuraminidase__InfluenzaA__ACV70787
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagugggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47942 - RNA, 1410 nt, Artificial Sequence; identical to SEQ ID NO: 47445
  neuraminidase__InfluenzaA__ACV70797

SEQ ID NO: 47943 - RNA, 1410 nt, Artificial Sequence; identical to SEQ ID NO: 47445
  neuraminidase__InfluenzaA__ACV70807

SEQ ID NO: 47944 - RNA, 1410 nt, Artificial Sequence; identical to SEQ ID NO: 47445
  neuraminidase__InfluenzaA__ACV70817

SEQ ID NO: 47945 - RNA, 1410 nt, Artificial Sequence; identical to SEQ ID NO: 47241
  neuraminidase__InfluenzaA__ACV70827

SEQ ID NO: 47946 - RNA, 1410 nt, Artificial Sequence; identical to SEQ ID NO: 47445
  neuraminidase__InfluenzaA__ACV70837

SEQ ID NO: 47947 - RNA, 1410 nt, Artificial Sequence
  neuraminidase__InfluenzaA__ACV70847
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucaugucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47948 - RNA, 1410 nt, Artificial Sequence
  neuraminidase__InfluenzaA__ACV70867
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaaggaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47949 - RNA, 1410 nt, Artificial Sequence; identical to SEQ ID NO: 47445
  neuraminidase__InfluenzaA__ACV70877

SEQ ID NO: 47950 - RNA, 1410 nt, Artificial Sequence
  neuraminidase__InfluenzaA__ACV70887
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugaugguaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 47951 - RNA, 1410 nt, Artificial Sequence; identical to SEQ ID NO: 47445
  neuraminidase__InfluenzaA__ACV70897

SEQ ID NO: 47952 - RNA, 1410 nt, Artificial Sequence; identical to SEQ ID NO: 47445
  neuraminidase__InfluenzaA__ACV70907

SEQ ID NO: 47953 - RNA, 1410 nt, Artificial Sequence; identical to SEQ ID NO: 47445
  neuraminidase__InfluenzaA__ACV70917

SEQ ID NO: 47954 - RNA, 1410 nt, Artificial Sequence; identical to SEQ ID NO: 47241
  neuraminidase__InfluenzaA__ACV70927

SEQ ID NO: 47955 - RNA, 1410 nt, Artificial Sequence; identical to SEQ ID NO: 47445
  neuraminidase__InfluenzaA__ACV70937

SEQ ID NO: 47956 - RNA, 1410 nt, Artificial Sequence; identical to SEQ ID NO: 47445
  neuraminidase__InfluenzaA__ACV70947

SEQ ID NO: 47957 - RNA, 1410 nt, Artificial Sequence; identical to SEQ ID NO: 47445
  neuraminidase__InfluenzaA__ACV70957

SEQ ID NO: 47958 - RNA, 1410 nt, Artificial Sequence; identical to SEQ ID NO: 47445
  neuraminidase__InfluenzaA__ACV70967

SEQ ID NO: 47959 - RNA, 1410 nt, Artificial Sequence
  neuraminidase__InfluenzaA__ACV70977
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagcaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47960 - RNA, 1410 nt, Artificial Sequence; identical to SEQ ID NO: 47445
  neuraminidase__InfluenzaA__ACV70987

SEQ ID NO: 47961 - RNA, 1410 nt, Artificial Sequence
  neuraminidase__InfluenzaA__ACV71007
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47962 - RNA, 1410 nt, Artificial Sequence
  neuraminidase__InfluenzaA__ACV82218
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47963 - RNA, 1410 nt, Artificial Sequence
  neuraminidase__InfluenzaA__ACV82219
augaauccaaaucaaaagauaauaacgauuggcucuguuucucucaccauuuccacaauaugcuucuucaugcaaauugccauccugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggaugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47964 - RNA, 1410 nt, Artificial Sequence
  neuraminidase__InfluenzaA__ACV82220
augaauccaaaucaaaagauaauaacgauuggcucuguuucucucaccauuuccacaauaugcuucuucaugcaacuugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcuacaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagagaaaacugaagucuuguggaccucaaacaguauuguuguguuuuguggcaccucagguacauauggaacaggcucauggccugauggggcggacaucaaucucaugccuauauaa

SEQ ID NO: 47965 - RNA, 1413 nt, Artificial Sequence
  neuraminidase__InfluenzaA__ACV82221
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagaaggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 47966 - RNA, 1410 nt, Artificial Sequence; identical to SEQ ID NO: 47242
  neuraminidase__InfluenzaA__ACV88402

SEQ ID NO: 47967 - RNA, 1410 nt, Artificial Sequence; identical to SEQ ID NO: 47242
  neuraminidase__InfluenzaA__ACV88412

SEQ ID NO: 47968 - RNA, 1410 nt, Artificial Sequence; identical to SEQ ID NO: 47241
  neuraminidase__InfluenzaA__ACV88422

SEQ ID NO: 47969 - RNA, 1365 nt, Artificial Sequence
  neuraminidase__InfluenzaA__ACV89505
augaauccaaaucagaaaauaauaaccauuggaucaaucugucugguagucggacuaauuagccuaauauugcaaauagggaauauaaucucaauauggauuagccauucaauucaaacuggaagucaaaaccauacuggaauaugcaaccaaaacaucauuaccuauaaaaauagcaccuggguaaaggacacaacuucagugauauuaaccggcaauucaucucuuugucccauccgugggugggcuauauacagcaaagacaauagcauaagaauugguuccaaaggagacguuuuugucauaagagagcccuuuauuucauguucucacuuggaaugcaggaccuuuuuucugacccaaggugccuuacugaaugacaagcauucaagugggacuguuaaggacagaagcccuuauagggccuuaaugagcugcccugucggugaagcuccguccccguacaauucaagauuugaaucgguugcuuggucagcaagugcaugucaugauggcaugggcuggcuaacaaucggaauuucagguccagauaauggagcaguggcuguauuaaaauacaacggcauaauaacugaaaccauaaaaaguuggaggaagaaaauauugaggacacaagagucugaaugugccuguguaaaugguucauguuuuacuauaaugacugauggcccgagugaugggcuggccucguacaaaauuuucaagaucgaaaaggggaagguuacuaaaucaauagaguugaaugcaccuaauucucacuaugaggaauguuccuguuacccugauaccggcaaagugaugugugugugcagagacaauuggcaugguucgaaccggccaugggugucuuucgaucaaaaccuggauuaucaaauaggauacaucugcagugggguuuucggugacaacccgcgucccgaagauggaacaggcagcugugguccaguguauguugauggagcaaacggaguaaagggauuuucauauagguaugguaaugguguuuggauaggaaggaccaaaagucacaguuccagacauggguuugagaugauuugggauccuaauggauggacagagacugauaguaaguucucugugaggcaagauguuguggcaaugacugauuggucaggguauagcggaaguuucguucaacauccugagcugacagggcuagacuguaugaggccgugcuucuggguugaauuaaucaggggacgaccuaaggagggaacaaucuggacuagugcgagcagcauuucuuuuuguggcgugaauagugauacuguagauuggucuuggccagacggugcugaguugccauucagcauugacaaguag

SEQ ID NO: 47970 - RNA, 1410 nt, Artificial Sequence; identical to SEQ ID NO: 47242
  neuraminidase__InfluenzaA__ACV91673

SEQ ID NO: 47971 - RNA, 1410 nt, Artificial Sequence; identical to SEQ ID NO: 47441
  neuraminidase__InfluenzaA__ACV91681

SEQ ID NO: 47972 - RNA, 1410 nt, Artificial Sequence
  neuraminidase__InfluenzaA__ACX31593
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugcugcugugugaaccagcaauaauagaaagaaacauaacagagauaguauaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggagggaaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 47973 - RNA, 1410 nt, Artificial Sequence
  neuraminidase__InfluenzaA__ACX31901
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47974 - RNA, 1410 nt, Artificial Sequence; identical to SEQ ID NO: 47242
  neuraminidase__InfluenzaA__ACX31902

SEQ ID NO: 47975 - RNA, 1410 nt, Artificial Sequence
  neuraminidase__InfluenzaA__ACX31905
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47976 - RNA, 1410 nt, Artificial Sequence; identical to SEQ ID NO: 47242
  neuraminidase__InfluenzaA__ACX31906

SEQ ID NO: 47977 - RNA, 1410 nt, Artificial Sequence; identical to SEQ ID NO: 47242
  neuraminidase__InfluenzaA__ACX31907

SEQ ID NO: 47978 - RNA, 1410 nt, Artificial Sequence; identical to SEQ ID NO: 47242
  neuraminidase__InfluenzaA__ACX31908

SEQ ID NO: 47979 - RNA, 1410 nt, Artificial Sequence
  neuraminidase__InfluenzaA__ACX31909
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47980 - RNA, 1410 nt, Artificial Sequence; identical to SEQ ID NO: 47242
  neuraminidase__InfluenzaA__ACX31911

SEQ ID NO: 47981 - RNA, 1410 nt, Artificial Sequence; identical to SEQ ID NO: 47242
  neuraminidase__InfluenzaA__ACX31912

SEQ ID NO: 47982 - RNA, 1410 nt, Artificial Sequence
  neuraminidase__InfluenzaA__ACX31913
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggaccgggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47983 - RNA, 1410 nt, Artificial Sequence; identical to SEQ ID NO: 47242
  neuraminidase__InfluenzaA__ACX31914

SEQ ID NO: 47984 - RNA, 1410 nt, Artificial Sequence; identical to SEQ ID NO: 47441
  neuraminidase__InfluenzaA__ACX31915

SEQ ID NO: 47985 - RNA, 1410 nt, Artificial Sequence; identical to SEQ ID NO: 47242
  neuraminidase__InfluenzaA__ACX31916

SEQ ID NO: 47986 - RNA, 1410 nt, Artificial Sequence
  neuraminidase__InfluenzaA__ACX31917
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuacagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47987 - RNA, 1410 nt, Artificial Sequence; identical to SEQ ID NO: 47242
  neuraminidase__InfluenzaA__ACX31918

SEQ ID NO: 47988 - RNA, 1410 nt, Artificial Sequence; identical to SEQ ID NO: 47242
  neuraminidase__InfluenzaA__ACX31919

SEQ ID NO: 47989 - RNA, 1410 nt, Artificial Sequence; identical to SEQ ID NO: 47242
  neuraminidase__InfluenzaA__ACX31920

SEQ ID NO: 47990 - RNA, 1410 nt, Artificial Sequence; identical to SEQ ID NO: 47649
  neuraminidase__InfluenzaA__ACX31922

SEQ ID NO: 47991 - RNA, 1410 nt, Artificial Sequence; identical to SEQ ID NO: 47441
  neuraminidase__InfluenzaA__ACX31923

SEQ ID NO: 47992 - RNA, 1410 nt, Artificial Sequence; identical to SEQ ID NO: 47305
  neuraminidase__InfluenzaA__ACX31924

SEQ ID NO: 47993 - RNA, 1410 nt, Artificial Sequence
  neuraminidase__InfluenzaA__ACX31925
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuuuaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaucauugacaaguaa

SEQ ID NO: 47994 - RNA, 1410 nt, Artificial Sequence; identical to SEQ ID NO: 47242
  neuraminidase__InfluenzaA__ACX31926

SEQ ID NO: 47995 - RNA, 1410 nt, Artificial Sequence; identical to SEQ ID NO: 47242
  neuraminidase__InfluenzaA__ACX31927

SEQ ID NO: 47996 - RNA, 1410 nt, Artificial Sequence
  neuraminidase__InfluenzaA__ACX31928
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagaaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacggugacacuguggguuggucuuggccagacggugcugaguugccauuuaccauugacaaguaa

SEQ ID NO: 47997 - RNA, 1410 nt, Artificial Sequence; identical to SEQ ID NO: 47272
  neuraminidase__InfluenzaA__ACX31929

SEQ ID NO: 47998 - RNA, 1410 nt, Artificial Sequence
  neuraminidase__InfluenzaA__ACX31930
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauucuaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 47999 - RNA, 1410 nt, Artificial Sequence; identical to SEQ ID NO: 47441
  neuraminidase__InfluenzaA__ACX31931

SEQ ID NO: 48000 - RNA, 1410 nt, Artificial Sequence; identical to SEQ ID NO: 47242
  neuraminidase__InfluenzaA__ACX31932

SEQ ID NO: 48001 - RNA, 1410 nt, Artificial Sequence; identical to SEQ ID NO: 47242
  neuraminidase__InfluenzaA__ACX35250

SEQ ID NO: 48002 - RNA, 1410 nt, Artificial Sequence; identical to SEQ ID NO: 47242
  neuraminidase__InfluenzaA__ACX35260

SEQ ID NO: 48003 - RNA, 1410 nt, Artificial Sequence; identical to SEQ ID NO: 47242
  neuraminidase__InfluenzaA__ACX35270

SEQ ID NO: 48004 - RNA, 1410 nt, Artificial Sequence
  neuraminidase__InfluenzaA__ACX35280
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgacaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48005 - RNA, 1410 nt, Artificial Sequence; identical to SEQ ID NO: 47242
  neuraminidase__InfluenzaA__ACX35290

SEQ ID NO: 48006 - RNA, 1410 nt, Artificial Sequence; identical to SEQ ID NO: 47362
  neuraminidase__InfluenzaA__ACX35300

SEQ ID NO: 48007 - RNA, 1410 nt, Artificial Sequence
  neuraminidase__InfluenzaA__ACX35310
augaauccaaaccaaaagauaauaaccauugguucggucuguaugacaauuggaauggcuaacuuaauauuacaaauuggaaacauaaucucaauauggauuagccacucaauucaacuugggaaucaaaaucagauuggaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48008 - RNA, 1410 nt, Artificial Sequence; identical to SEQ ID NO: 47242
  neuraminidase__InfluenzaA__ACX35320

SEQ ID NO: 48009 - RNA, 1410 nt, Artificial Sequence
  neuraminidase__InfluenzaA__ACX35330
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48010 - RNA, 1410 nt, Artificial Sequence; identical to SEQ ID NO: 47242
  neuraminidase__InfluenzaA__ACX48479

SEQ ID NO: 48011 - RNA, 1410 nt, Artificial Sequence; identical to SEQ ID NO: 47306
  neuraminidase__InfluenzaA__ACX48481

SEQ ID NO: 48012 - RNA, 1410 nt, Artificial Sequence; identical to SEQ ID NO: 47242
  neuraminidase__InfluenzaA__ACX55836

SEQ ID NO: 48013 - RNA, 1410 nt, Artificial Sequence
  neuraminidase__InfluenzaA__ACX56269
augaauccaaaacaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48014 - RNA, 1410 nt, Artificial Sequence
  neuraminidase__InfluenzaA__ACX56270
augaauccaaaacaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacucugugaguuggucuuggccagacggugcugaguugccauuuaccauugacaaguaa

SEQ ID NO: 48015 - RNA, 1410 nt, Artificial Sequence
  neuraminidase__InfluenzaA__ACX56271
augaauccaaaacaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaaccuugcugcuggacagucaguggguuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48016 - RNA, 1410 nt, Artificial Sequence
  neuraminidase__InfluenzaA__ACX83579
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagcaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48017 - RNA, 1410 nt, Artificial Sequence
  neuraminidase__InfluenzaA__ACX85425
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcaugguucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48018 - RNA, 1410 nt, Artificial Sequence; identical to SEQ ID NO: 48017
  neuraminidase__InfluenzaA__ACX85426

SEQ ID NO: 48019 - RNA, 1410 nt, Artificial Sequence
  neuraminidase__InfluenzaA__ACY02998
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuagaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48020 - RNA, 1410 nt, Artificial Sequence; identical to SEQ ID NO: 47286
  neuraminidase__InfluenzaA__ACY03005

SEQ ID NO: 48021 - RNA, 1410 nt, Artificial Sequence; identical to SEQ ID NO: 47242
  neuraminidase__InfluenzaA__ACY03008

SEQ ID NO: 48022 - RNA, 1410 nt, Artificial Sequence; identical to SEQ ID NO: 47306
  neuraminidase__InfluenzaA__ACY03011

SEQ ID NO: 48023 - RNA, 1410 nt, Artificial Sequence; identical to SEQ ID NO: 47242
  neuraminidase__InfluenzaA__ACY03012

SEQ ID NO: 48024 - RNA, 1410 nt, Artificial Sequence
  neuraminidase__InfluenzaA__ACY03016
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguucuaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48025 - RNA, 1410 nt, Artificial Sequence
  neuraminidase__InfluenzaA__ACY26194
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagauaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48026 - RNA, 1410 nt, Artificial Sequence
  neuraminidase__InfluenzaA__ACY26204
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcggaagcagcauauccuuuugugguguaaacagugacacuguggguuggucuuggccagacggugcugaguugccauuuaccauugacaaguaa

SEQ ID NO: 48027 - RNA, 1410 nt, Artificial Sequence; identical to SEQ ID NO: 47439
  neuraminidase__InfluenzaA__ACY30123

SEQ ID NO: 48028 - RNA, 1410 nt, Artificial Sequence; identical to SEQ ID NO: 47707
  neuraminidase__InfluenzaA__ACY30124

SEQ ID NO: 48029 - RNA, 1410 nt, Artificial Sequence; identical to SEQ ID NO: 47306
  neuraminidase__InfluenzaA__ACY30125

SEQ ID NO: 48030 - RNA, 1410 nt, Artificial Sequence; identical to SEQ ID NO: 47242
  neuraminidase__InfluenzaA__ACY30127

SEQ ID NO: 48031 - RNA, 1410 nt, Artificial Sequence; identical to SEQ ID NO: 47306
  neuraminidase__InfluenzaA__ACY30128

SEQ ID NO: 48032 - RNA, 1410 nt, Artificial Sequence; identical to SEQ ID NO: 47242
  neuraminidase__InfluenzaA__ACY46105

SEQ ID NO: 48033 - RNA, 1410 nt, Artificial Sequence; identical to SEQ ID NO: 47242
  neuraminidase__InfluenzaA__ACY46165

SEQ ID NO: 48034 - RNA, 1410 nt, Artificial Sequence; identical to SEQ ID NO: 47242
  neuraminidase__InfluenzaA__ACY46175

SEQ ID NO: 48035 - RNA, 1410 nt, Artificial Sequence
  neuraminidase__InfluenzaA__ACY46345
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48036 - RNA, 1410 nt, Artificial Sequence
  neuraminidase__InfluenzaA__ACY46385
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauaugucaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48037 - RNA, 1410 nt, Artificial Sequence; identical to SEQ ID NO: 47242
  neuraminidase__InfluenzaA__ACY46485

SEQ ID NO: 48038 - RNA, 1410 nt, Artificial Sequence; identical to SEQ ID NO: 47272
  neuraminidase__InfluenzaA__ACY77536

SEQ ID NO: 48039 - RNA, 1410 nt, Artificial Sequence; identical to SEQ ID NO: 47241
  neuraminidase__InfluenzaA__ACY77546

SEQ ID NO: 48040 - RNA, 1410 nt, Artificial Sequence; identical to SEQ ID NO: 47272
  neuraminidase__InfluenzaA__ACY77565

SEQ ID NO: 48041 - RNA, 1410 nt, Artificial Sequence
  neuraminidase__InfluenzaA__ACY77575
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugcccccaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuagugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48042 - RNA, 1410 nt, Artificial Sequence; identical to SEQ ID NO: 47242
  neuraminidase__InfluenzaA__ACY77585

SEQ ID NO: 48043 - RNA, 1410 nt, Artificial Sequence; identical to SEQ ID NO: 47272
  neuraminidase__InfluenzaA__ACY77595

SEQ ID NO: 48044 - RNA, 1410 nt, Artificial Sequence; identical to SEQ ID NO: 47272
  neuraminidase__InfluenzaA__ACY77605

SEQ ID NO: 48045 - RNA, 1410 nt, Artificial Sequence
  neuraminidase__InfluenzaA__ACY77625
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguugguccuggccagacggugcugaguugccauuuaccauugacaaguaa

SEQ ID NO: 48046 - RNA, 1410 nt, Artificial Sequence
  neuraminidase__InfluenzaA__ACY77655
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguuuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48047 - RNA, 1410 nt, Artificial Sequence; identical to SEQ ID NO: 47242
  neuraminidase__InfluenzaA__ACY77665

SEQ ID NO: 48048 - RNA, 1410 nt, Artificial Sequence; identical to SEQ ID NO: 47242
  neuraminidase__InfluenzaA__ACY77675

SEQ ID NO: 48049 - RNA, 1410 nt, Artificial Sequence; identical to SEQ ID NO: 47560
  neuraminidase__InfluenzaA__ACY77685

SEQ ID NO: 48050 - RNA, 1410 nt, Artificial Sequence
  neuraminidase__InfluenzaA__ACY77695
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48051 - RNA, 1410 nt, Artificial Sequence; identical to SEQ ID NO: 48050
  neuraminidase__InfluenzaA__ACY77705

SEQ ID NO: 48052 - RNA, 1410 nt, Artificial Sequence
  neuraminidase__InfluenzaA__ACY77725
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48053 - RNA, 1410 nt, Artificial Sequence
  neuraminidase__InfluenzaA__ACY77735
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuagauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48054 - RNA, 1410 nt, Artificial Sequence; identical to SEQ ID NO: 47562
  neuraminidase__InfluenzaA__ACY77745

SEQ ID NO: 48055 - RNA, 1410 nt, Artificial Sequence; identical to SEQ ID NO: 47242
  neuraminidase__InfluenzaA__ACY77755

SEQ ID NO: 48056 - RNA, 1410 nt, Artificial Sequence
  neuraminidase__InfluenzaA__ACY77775
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggaguagcauauccuuuugugguguaaacagugacacuguggguuggucuuggccagacggugcugaguugccauuuaccauugacaaguaa

SEQ ID NO: 48057 - RNA, 1410 nt, Artificial Sequence; identical to SEQ ID NO: 47242
  neuraminidase__InfluenzaA__ACY77785

SEQ ID NO: 48058 - RNA, 1410 nt, Artificial Sequence
  neuraminidase__InfluenzaA__ACY77795
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucugugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggaguagcauauccuuuugugguguaaacagugacacuguggguuggucuuggccagacggugcugaguugccauuuaccauugacaaguaa

SEQ ID NO: 48059 - RNA, 1410 nt, Artificial Sequence
  neuraminidase__InfluenzaA__ACY77825
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48060 - RNA, 1410 nt, Artificial Sequence; identical to SEQ ID NO: 48059
  neuraminidase__InfluenzaA__ACY77835

SEQ ID NO: 48061 - RNA, 1410 nt, Artificial Sequence; identical to SEQ ID NO: 47272
  neuraminidase__InfluenzaA__ACY77845

SEQ ID NO: 48062 - RNA, 1410 nt, Artificial Sequence; identical to SEQ ID NO: 47242
  neuraminidase__InfluenzaA__ACY77865

SEQ ID NO: 48063 - RNA, 1410 nt, Artificial Sequence
  neuraminidase__InfluenzaA__ACY77870
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaaccuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48064 - RNA, 1410 nt, Artificial Sequence; identical to SEQ ID NO: 47445
  neuraminidase__InfluenzaA__ACY77877

SEQ ID NO: 48065 - RNA, 1410 nt, Artificial Sequence; identical to SEQ ID NO: 47445
  neuraminidase__InfluenzaA__ACY77887

SEQ ID NO: 48066 - RNA, 1410 nt, Artificial Sequence; identical to SEQ ID NO: 47242
  neuraminidase__InfluenzaA__ACY77907

SEQ ID NO: 48067 - RNA, 1410 nt, Artificial Sequence; identical to SEQ ID NO: 47272
  neuraminidase__InfluenzaA__ACY77917

SEQ ID NO: 48068 - RNA, 1410 nt, Artificial Sequence
  neuraminidase__InfluenzaA__ACY77927
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaaacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48069 - RNA, 1410 nt, Artificial Sequence; identical to SEQ ID NO: 47796
  neuraminidase__InfluenzaA__ACY77937

SEQ ID NO: 48070 - RNA, 1410 nt, Artificial Sequence; identical to SEQ ID NO: 47445
  neuraminidase__InfluenzaA__ACY77947

SEQ ID NO: 48071 - RNA, 1410 nt, Artificial Sequence; identical to SEQ ID NO: 47445
  neuraminidase__InfluenzaA__ACY77967

SEQ ID NO: 48072 - RNA, 1410 nt, Artificial Sequence; identical to SEQ ID NO: 47253
  neuraminidase__InfluenzaA__ACY77977

SEQ ID NO: 48073 - RNA, 1410 nt, Artificial Sequence; identical to SEQ ID NO: 47445
  neuraminidase__InfluenzaA__ACY77987

SEQ ID NO: 48074 - RNA, 1410 nt, Artificial Sequence
  neuraminidase__InfluenzaA__ACY77997
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugacauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 48075 - RNA, 1410 nt, Artificial Sequence
  neuraminidase__InfluenzaA__ACY78017
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuaccguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 48076 - RNA, 1410 nt, Artificial Sequence
  neuraminidase__InfluenzaA__ACZ01955
augaauccaaaccaaaagauaaucaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaggcaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48077 - RNA, 1410 nt, Artificial Sequence; identical to SEQ ID NO: 47445
  neuraminidase__InfluenzaA__ACZ05053

SEQ ID NO: 48078 - RNA, 1410 nt, Artificial Sequence; identical to SEQ ID NO: 47241
  neuraminidase__InfluenzaA__ACZ05064

SEQ ID NO: 48079 - RNA, 1410 nt, Artificial Sequence; identical to SEQ ID NO: 47445
  neuraminidase__InfluenzaA__ACZ05074

SEQ ID NO: 48080 - RNA, 1410 nt, Artificial Sequence; identical to SEQ ID NO: 47445
  neuraminidase__InfluenzaA__ACZ05084

SEQ ID NO: 48081 - RNA, 1410 nt, Artificial Sequence; identical to SEQ ID NO: 47445
  neuraminidase__InfluenzaA__ACZ05094

SEQ ID NO: 48082 - RNA, 1410 nt, Artificial Sequence; identical to SEQ ID NO: 47445
  neuraminidase__InfluenzaA__ACZ05104

SEQ ID NO: 48083 - RNA, 1410 nt, Artificial Sequence; identical to SEQ ID NO: 47445
  neuraminidase__InfluenzaA__ACZ05114

SEQ ID NO: 48084 - RNA, 1410 nt, Artificial Sequence
  neuraminidase__InfluenzaA__ACZ05124
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacuugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48085 - RNA, 1410 nt, Artificial Sequence; identical to SEQ ID NO: 47445
  neuraminidase__InfluenzaA__ACZ05144

SEQ ID NO: 48086 - RNA, 1410 nt, Artificial Sequence; identical to SEQ ID NO: 47445
  neuraminidase__InfluenzaA__ACZ05154

SEQ ID NO: 48087 - RNA, 1410 nt, Artificial Sequence
  neuraminidase__InfluenzaA__ACZ05164
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48088 - RNA, 1410 nt, Artificial Sequence; identical to SEQ ID NO: 48087
  neuraminidase__InfluenzaA__ACZ05175

SEQ ID NO: 48089 - RNA, 1413 nt, Artificial Sequence
  neuraminidase__InfluenzaA__ACZ05197
augaacccaaaucaaaagauaaugaccauuggaucaaucaguauagcaaucggaauaauuagucuaauguugcaaauaggaaauauuauuucaauaugggcuagucacucgauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguucaacauccugaguugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48090 - RNA, 1410 nt, Artificial Sequence
  neuraminidase__InfluenzaA__ACZ05208
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguucggauccuaacaaugaggaagguggucauggggugaaaggcugggccuuugauaguggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48091 - RNA, 1410 nt, Artificial Sequence
  neuraminidase__InfluenzaA__ACZ05219
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguggcauuacaggauuugcaccuuuuucuaaggacaauucgauuaggcuuuccgcugguggggacaucugggugacgagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaaugguacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaauaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48092 - RNA, 1410 nt, Artificial Sequence; identical to SEQ ID NO: 48087
  neuraminidase__InfluenzaA__ACZ05230

SEQ ID NO: 48093 - RNA, 1410 nt, Artificial Sequence
  neuraminidase__InfluenzaA__ACZ05241
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcaaauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgauaagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48094 - RNA, 1413 nt, Artificial Sequence
  neuraminidase__InfluenzaA__ACZ05296
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcaucagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauuaaaaguuggaaaaagcaaauauuaagaacacaagagucugaaugugucuguaugaacgggucauguuucaccauaaugacugauggcccgaguaauaaggccgccucguacaaaauuuucaagaucgaaaaagggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucagauaggauacaucugcaguggaguguuuggugacaauccgcgucccgaagauggagagggcagcugcaauccaguggcuguugauggagcaaauggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48095 - RNA, 1410 nt, Artificial Sequence; identical to SEQ ID NO: 48087
  neuraminidase__InfluenzaA__ACZ05307

SEQ ID NO: 48096 - RNA, 1410 nt, Artificial Sequence
  neuraminidase__InfluenzaA__ACZ05318
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 48097 - RNA, 1410 nt, Artificial Sequence; identical to SEQ ID NO: 48087
  neuraminidase__InfluenzaA__ACZ05329

SEQ ID NO: 48098 - RNA, 1410 nt, Artificial Sequence
  neuraminidase__InfluenzaA__ACZ05340
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaaugacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguagaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48099 - RNA, 1410 nt, Artificial Sequence
  neuraminidase__InfluenzaA__ACZ05362
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcaaauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48100 - RNA, 1410 nt, Artificial Sequence; identical to SEQ ID NO: 48087
  neuraminidase__InfluenzaA__ACZ05373

SEQ ID NO: 48101 - RNA, 1410 nt, Artificial Sequence
  neuraminidase__InfluenzaA__ACZ05395
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacacaaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48102 - RNA, 1410 nt, Artificial Sequence
  neuraminidase__InfluenzaA__ACZ05406
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugagcuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguuaauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48103 - RNA, 1413 nt, Artificial Sequence
  neuraminidase__InfluenzaA__ACZ05450
augaacccaaaucaaaagauaauaaccauuggaucaaucaguauagcaaucggaauaauuagucuaauguugcaaauaggaaguauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcguaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaagccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaauuuggauuaucaaauaggauacaucugcaguggaguguuuggugacaauccgcgucccgaagauggagagggcagcugcaauccagugacuguagauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaauugacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48104 - RNA, 1410 nt, Artificial Sequence; identical to SEQ ID NO: 48087
  neuraminidase__InfluenzaA__ACZ05461

SEQ ID NO: 48105 - RNA, 1410 nt, Artificial Sequence; identical to SEQ ID NO: 48087
  neuraminidase__InfluenzaA__ACZ05472

SEQ ID NO: 48106 - RNA, 1410 nt, Artificial Sequence
  neuraminidase__InfluenzaA__ACZ05483
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccguagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48107 - RNA, 1410 nt, Artificial Sequence
  neuraminidase__InfluenzaA__ACZ05494
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucgaacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48108 - RNA, 1410 nt, Artificial Sequence
  neuraminidase__InfluenzaA__ACZ05516
augaauccaaaucaaaagauaauaacgauuggcucuguuucucucaccauuuccacaauaugcuucuucaugcaaaccgccauccugauaacuacugugacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 48109 - RNA, 1410 nt, Artificial Sequence
  neuraminidase__InfluenzaA__ACZ05527
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguucggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48110 - RNA, 1410 nt, Artificial Sequence; identical to SEQ ID NO: 48099
  neuraminidase__InfluenzaA__ACZ05538

SEQ ID NO: 48111 - RNA, 1413 nt, Artificial Sequence
  neuraminidase__InfluenzaA__ACZ05593
augaacccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucauuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggaauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48112 - RNA, 1413 nt, Artificial Sequence
  neuraminidase__InfluenzaA__ACZ05604
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuauccguggaugggcuauauacacaaaagacaacagcauaagaauuggcuccaaaggagauguuuuugucauaagagaaccuuucauaucauguucucacuuggaaugcagaaccuucuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48113 - RNA, 1410 nt, Artificial Sequence; identical to SEQ ID NO: 48087
  neuraminidase__InfluenzaA__ACZ05953

SEQ ID NO: 48114 - RNA, 1410 nt, Artificial Sequence; identical to SEQ ID NO: 48109
  neuraminidase__InfluenzaA__ACZ05964

SEQ ID NO: 48115 - RNA, 1410 nt, Artificial Sequence; identical to SEQ ID NO: 48087
  neuraminidase__InfluenzaA__ACZ05997

SEQ ID NO: 48116 - RNA, 1410 nt, Artificial Sequence; identical to SEQ ID NO: 48109
  neuraminidase__InfluenzaA__ACZ06008

SEQ ID NO: 48117 - RNA, 1410 nt, Artificial Sequence; identical to SEQ ID NO: 48109
  neuraminidase__InfluenzaA__ACZ06019

SEQ ID NO: 48118 - RNA, 1413 nt, Artificial Sequence
  neuraminidase__InfluenzaA__ACZ16015
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuacagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaauguguuuguaugaacgggucauguuucaccauaaugaccgauggcccgaguaauaaggccgccucguacaaaauuuucaagaucgaaaaggggaagguuucuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcuaccuagagaaaauacaacaaucuggacuagugggagcagcauuucuuuuuguggcguuaauagugauacugcaaacuggucuuggccagacggugcugaguugccguucaccauugacaaguag

SEQ ID NO: 48119 - RNA, 1413 nt, Artificial Sequence
  neuraminidase__InfluenzaA__ACZ16025
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccauaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48120 - RNA, 1413 nt, Artificial Sequence
  neuraminidase__InfluenzaA__ACZ16035
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaaggaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugucaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacauuugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48121 - RNA, 1410 nt, Artificial Sequence
  neuraminidase__InfluenzaA__ACZ16043
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaauauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48122 - RNA, 1410 nt, Artificial Sequence
  neuraminidase__InfluenzaA__ACZ16053
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48123 - RNA, 1410 nt, Artificial Sequence
  neuraminidase__InfluenzaA__ACZ16073
augaauccaaaccaaaagauaauaaccauugguucggucuguaugacaauuggaauggcuaacuuaauauuacaaauuggaaauauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauugguuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaaggccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48124 - RNA, 1410 nt, Artificial Sequence
  neuraminidase__InfluenzaA__ACZ16083
augaauccaaaccaaaagauaauaaccauugguucggucuguaugacaaucggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuagacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuugggaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48125 - RNA, 1410 nt, Artificial Sequence; identical to SEQ ID NO: 47232
  neuraminidase__InfluenzaA__ACZ16093

SEQ ID NO: 48126 - RNA, 1410 nt, Artificial Sequence; identical to SEQ ID NO: 47445
  neuraminidase__InfluenzaA__ACZ16103

SEQ ID NO: 48127 - RNA, 1410 nt, Artificial Sequence; identical to SEQ ID NO: 47445
  neuraminidase__InfluenzaA__ACZ16113

SEQ ID NO: 48128 - RNA, 1410 nt, Artificial Sequence
  neuraminidase__InfluenzaA__ACZ16123
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48129 - RNA, 1410 nt, Artificial Sequence
  neuraminidase__InfluenzaA__ACZ16133
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48130 - RNA, 1410 nt, Artificial Sequence
  neuraminidase__InfluenzaA__ACZ16143
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccauuaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48131 - RNA, 1410 nt, Artificial Sequence; identical to SEQ ID NO: 47445
  neuraminidase__InfluenzaA__ACZ16153

SEQ ID NO: 48132 - RNA, 1410 nt, Artificial Sequence; identical to SEQ ID NO: 47445
  neuraminidase__InfluenzaA__ACZ16163

SEQ ID NO: 48133 - RNA, 1410 nt, Artificial Sequence; identical to SEQ ID NO: 47241
  neuraminidase__InfluenzaA__ACZ16173

SEQ ID NO: 48134 - RNA, 1410 nt, Artificial Sequence; identical to SEQ ID NO: 47445
  neuraminidase__InfluenzaA__ACZ16193

SEQ ID NO: 48135 - RNA, 1410 nt, Artificial Sequence; identical to SEQ ID NO: 47445
  neuraminidase__InfluenzaA__ACZ16203

SEQ ID NO: 48136 - RNA, 1410 nt, Artificial Sequence; identical to SEQ ID NO: 47445
  neuraminidase__InfluenzaA__ACZ16213

SEQ ID NO: 48137 - RNA, 1410 nt, Artificial Sequence
  neuraminidase__InfluenzaA__ACZ16223
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaaugaaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48138 - RNA, 1410 nt, Artificial Sequence; identical to SEQ ID NO: 47445
  neuraminidase__InfluenzaA__ACZ16233

SEQ ID NO: 48139 - RNA, 1410 nt, Artificial Sequence
  neuraminidase__InfluenzaA__ACZ16243
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 48140 - RNA, 1410 nt, Artificial Sequence
  neuraminidase__InfluenzaA__ACZ16253
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuuguggugugaacagugacacuguggguuggucuuggccagacggugcugaguugccauuuaacauugacaaguaa

SEQ ID NO: 48141 - RNA, 1410 nt, Artificial Sequence; identical to SEQ ID NO: 47445
  neuraminidase__InfluenzaA__ACZ16263

SEQ ID NO: 48142 - RNA, 1410 nt, Artificial Sequence; identical to SEQ ID NO: 47241
  neuraminidase__InfluenzaA__ACZ16283

SEQ ID NO: 48143 - RNA, 1410 nt, Artificial Sequence; identical to SEQ ID NO: 47445
  neuraminidase__InfluenzaA__ACZ16293

SEQ ID NO: 48144 - RNA, 1410 nt, Artificial Sequence; identical to SEQ ID NO: 47445
  neuraminidase__InfluenzaA__ACZ16303

SEQ ID NO: 48145 - RNA, 1410 nt, Artificial Sequence; identical to SEQ ID NO: 47445
  neuraminidase__InfluenzaA__ACZ16313

SEQ ID NO: 48146 - RNA, 1410 nt, Artificial Sequence; identical to SEQ ID NO: 47445
  neuraminidase__InfluenzaA__ACZ16323

SEQ ID NO: 48147 - RNA, 1410 nt, Artificial Sequence; identical to SEQ ID NO: 47445
  neuraminidase__InfluenzaA__ACZ16333

SEQ ID NO: 48148 - RNA, 1410 nt, Artificial Sequence; identical to SEQ ID NO: 48139
  neuraminidase__InfluenzaA__ACZ16343

SEQ ID NO: 48149 - RNA, 1410 nt, Artificial Sequence; identical to SEQ ID NO: 47445
  neuraminidase__InfluenzaA__ACZ16353

SEQ ID NO: 48150 - RNA, 1410 nt, Artificial Sequence; identical to SEQ ID NO: 47445
  neuraminidase__InfluenzaA__ACZ16363

SEQ ID NO: 48151 - RNA, 1410 nt, Artificial Sequence; identical to SEQ ID NO: 47241
  neuraminidase__InfluenzaA__ACZ16373

SEQ ID NO: 48152 - RNA, 1410 nt, Artificial Sequence; identical to SEQ ID NO: 47445
  neuraminidase__InfluenzaA__ACZ16383

SEQ ID NO: 48153 - RNA, 1410 nt, Artificial Sequence; identical to SEQ ID NO: 47445
  neuraminidase__InfluenzaA__ACZ16393

SEQ ID NO: 48154 - RNA, 1410 nt, Artificial Sequence
  neuraminidase__InfluenzaA__ACZ16403
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacggggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48155 - RNA, 1410 nt, Artificial Sequence; identical to SEQ ID NO: 47242
  neuraminidase__InfluenzaA__ACZ16423

SEQ ID NO: 48156 - RNA, 1410 nt, Artificial Sequence; identical to SEQ ID NO: 47445
  neuraminidase__InfluenzaA__ACZ16433

SEQ ID NO: 48157 - RNA, 1410 nt, Artificial Sequence; identical to SEQ ID NO: 47445
  neuraminidase__InfluenzaA__ACZ16443

SEQ ID NO: 48158 - RNA, 1410 nt, Artificial Sequence; identical to SEQ ID NO: 47445
  neuraminidase__InfluenzaA__ACZ16453

SEQ ID NO: 48159 - RNA, 1410 nt, Artificial Sequence; identical to SEQ ID NO: 48139
  neuraminidase__InfluenzaA__ACZ16463

SEQ ID NO: 48160 - RNA, 1410 nt, Artificial Sequence; identical to SEQ ID NO: 47445
  neuraminidase__InfluenzaA__ACZ16483

SEQ ID NO: 48161 - RNA, 1410 nt, Artificial Sequence
  neuraminidase__InfluenzaA__ACZ16493
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacagcaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48162 - RNA, 1410 nt, Artificial Sequence
  neuraminidase__InfluenzaA__ACZ16503
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauggaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48163 - RNA, 1410 nt, Artificial Sequence; identical to SEQ ID NO: 48139
  neuraminidase__InfluenzaA__ACZ16513

SEQ ID NO: 48164 - RNA, 1410 nt, Artificial Sequence; identical to SEQ ID NO: 47445
  neuraminidase__InfluenzaA__ACZ16523

SEQ ID NO: 48165 - RNA, 1410 nt, Artificial Sequence; identical to SEQ ID NO: 47445
  neuraminidase__InfluenzaA__ACZ16533

SEQ ID NO: 48166 - RNA, 1410 nt, Artificial Sequence; identical to SEQ ID NO: 47241
  neuraminidase__InfluenzaA__ACZ16543

SEQ ID NO: 48167 - RNA, 1410 nt, Artificial Sequence; identical to SEQ ID NO: 47445
  neuraminidase__InfluenzaA__ACZ16553

SEQ ID NO: 48168 - RNA, 1410 nt, Artificial Sequence; identical to SEQ ID NO: 47445
  neuraminidase__InfluenzaA__ACZ16586

SEQ ID NO: 48169 - RNA, 1410 nt, Artificial Sequence; identical to SEQ ID NO: 47445
  neuraminidase__InfluenzaA__ACZ16596

SEQ ID NO: 48170 - RNA, 1410 nt, Artificial Sequence; identical to SEQ ID NO: 47445
  neuraminidase__InfluenzaA__ACZ16606

SEQ ID NO: 48171 - RNA, 1410 nt, Artificial Sequence; identical to SEQ ID NO: 47445
  neuraminidase__InfluenzaA__ACZ16633

SEQ ID NO: 48172 - RNA, 1410 nt, Artificial Sequence
  neuraminidase__InfluenzaA__ACZ16643
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaagguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48173 - RNA, 1410 nt, Artificial Sequence; identical to SEQ ID NO: 47445
  neuraminidase__InfluenzaA__ACZ16653

SEQ ID NO: 48174 - RNA, 1410 nt, Artificial Sequence
  neuraminidase__InfluenzaA__ACZ16663
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48175 - RNA, 1410 nt, Artificial Sequence; identical to SEQ ID NO: 47445
  neuraminidase__InfluenzaA__ACZ16673

SEQ ID NO: 48176 - RNA, 1410 nt, Artificial Sequence; identical to SEQ ID NO: 47445
  neuraminidase__InfluenzaA__ACZ16683

SEQ ID NO: 48177 - RNA, 1410 nt, Artificial Sequence; identical to SEQ ID NO: 47445
  neuraminidase__InfluenzaA__ACZ16693

SEQ ID NO: 48178 - RNA, 1410 nt, Artificial Sequence; identical to SEQ ID NO: 47445
  neuraminidase__InfluenzaA__ACZ16703

SEQ ID NO: 48179 - RNA, 1410 nt, Artificial Sequence; identical to SEQ ID NO: 47445
  neuraminidase__InfluenzaA__ACZ16713

SEQ ID NO: 48180 - RNA, 1410 nt, Artificial Sequence; identical to SEQ ID NO: 47445
  neuraminidase__InfluenzaA__ACZ16723

SEQ ID NO: 48181 - RNA, 1410 nt, Artificial Sequence; identical to SEQ ID NO: 47445
  neuraminidase__InfluenzaA__ACZ16733

SEQ ID NO: 48182 - RNA, 1410 nt, Artificial Sequence; identical to SEQ ID NO: 47445
  neuraminidase__InfluenzaA__ACZ16743

SEQ ID NO: 48183 - RNA, 1410 nt, Artificial Sequence; identical to SEQ ID NO: 47445
  neuraminidase__InfluenzaA__ACZ16753

SEQ ID NO: 48184 - RNA, 1410 nt, Artificial Sequence
  neuraminidase__InfluenzaA__ACZ16763
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48185 - RNA, 1410 nt, Artificial Sequence; identical to SEQ ID NO: 47241
  neuraminidase__InfluenzaA__ACZ16773

SEQ ID NO: 48186 - RNA, 1410 nt, Artificial Sequence
  neuraminidase__InfluenzaA__ACZ16783
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgccccaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuuguggugugaacagugacacuguggguuggucuuggccagacggugcugaguugccauuuaccauugacaaguaa

SEQ ID NO: 48187 - RNA, 1410 nt, Artificial Sequence; identical to SEQ ID NO: 47445
  neuraminidase__InfluenzaA__ACZ16793

SEQ ID NO: 48188 - RNA, 1410 nt, Artificial Sequence; identical to SEQ ID NO: 47445
  neuraminidase__InfluenzaA__ACZ16803

SEQ ID NO: 48189 - RNA, 1410 nt, Artificial Sequence; identical to SEQ ID NO: 47445
  neuraminidase__InfluenzaA__ACZ16813

SEQ ID NO: 48190 - RNA, 1410 nt, Artificial Sequence; identical to SEQ ID NO: 47241
  neuraminidase__InfluenzaA__ACZ16823

SEQ ID NO: 48191 - RNA, 1410 nt, Artificial Sequence
  neuraminidase__InfluenzaA__ACZ16833
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48192 - RNA, 1410 nt, Artificial Sequence; identical to SEQ ID NO: 47445
  neuraminidase__InfluenzaA__ACZ16843

SEQ ID NO: 48193 - RNA, 1410 nt, Artificial Sequence; identical to SEQ ID NO: 48162
  neuraminidase__InfluenzaA__ACZ16853

SEQ ID NO: 48194 - RNA, 1410 nt, Artificial Sequence
  neuraminidase__InfluenzaA__ACZ16863
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaacuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacgguaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48195 - RNA, 1410 nt, Artificial Sequence; identical to SEQ ID NO: 47445
  neuraminidase__InfluenzaA__ACZ16873

SEQ ID NO: 48196 - RNA, 1410 nt, Artificial Sequence; identical to SEQ ID NO: 47445
  neuraminidase__InfluenzaA__ACZ16883

SEQ ID NO: 48197 - RNA, 1410 nt, Artificial Sequence; identical to SEQ ID NO: 47445
  neuraminidase__InfluenzaA__ACZ16893

SEQ ID NO: 48198 - RNA, 1410 nt, Artificial Sequence; identical to SEQ ID NO: 47445
  neuraminidase__InfluenzaA__ACZ16903

SEQ ID NO: 48199 - RNA, 1410 nt, Artificial Sequence; identical to SEQ ID NO: 47445
  neuraminidase__InfluenzaA__ACZ16913

SEQ ID NO: 48200 - RNA, 1410 nt, Artificial Sequence; identical to SEQ ID NO: 47445
  neuraminidase__InfluenzaA__ACZ16923

SEQ ID NO: 48201 - RNA, 1410 nt, Artificial Sequence; identical to SEQ ID NO: 47242
  neuraminidase__InfluenzaA__ACZ16933

SEQ ID NO: 48202 - RNA, 1410 nt, Artificial Sequence; identical to SEQ ID NO: 47242
  neuraminidase__InfluenzaA__ACZ16943

SEQ ID NO: 48203 - RNA, 1410 nt, Artificial Sequence; identical to SEQ ID NO: 47253
  neuraminidase__InfluenzaA__ACZ16953

SEQ ID NO: 48204 - RNA, 1410 nt, Artificial Sequence; identical to SEQ ID NO: 47242
  neuraminidase__InfluenzaA__ACZ16963

SEQ ID NO: 48205 - RNA, 1410 nt, Artificial Sequence; identical to SEQ ID NO: 47242
  neuraminidase__InfluenzaA__ACZ16973

SEQ ID NO: 48206 - RNA, 1410 nt, Artificial Sequence
  neuraminidase__InfluenzaA__ACZ16983
augaauccaaaccaaaagauaauaaccauugguucggucuguaugacaauuggaauggcuaacuuaauauuacaaauuggaaacauaaucucaauauggauuagccacucaauucaacuugggaaucaaaaucaaauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaguaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48207 - RNA, 1410 nt, Artificial Sequence; identical to SEQ ID NO: 47242
  neuraminidase__InfluenzaA__ACZ16993

SEQ ID NO: 48208 - RNA, 1410 nt, Artificial Sequence; identical to SEQ ID NO: 47242
  neuraminidase__InfluenzaA__ACZ17003

SEQ ID NO: 48209 - RNA, 1410 nt, Artificial Sequence
  neuraminidase__InfluenzaA__ACZ17023
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaguauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguaucagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48210 - RNA, 1410 nt, Artificial Sequence; identical to SEQ ID NO: 47242
  neuraminidase__InfluenzaA__ACZ17043

SEQ ID NO: 48211 - RNA, 1410 nt, Artificial Sequence
  neuraminidase__InfluenzaA__ACZ17053
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcucacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48212 - RNA, 1410 nt, Artificial Sequence
  neuraminidase__InfluenzaA__ACZ17063
augaauccaaaccaaaagauaauaaccauugguucggucuguaugacaauuggaauggcuaacuuaauauuacaaauuggaaacauaaucucaauauggauuagccacucaauucaacuuggggaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuaucuacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguugguccuggccagacggugcugaguugccauuuaccauugacaaguaa

SEQ ID NO: 48213 - RNA, 1410 nt, Artificial Sequence; identical to SEQ ID NO: 47242
  neuraminidase__InfluenzaA__ACZ17073

SEQ ID NO: 48214 - RNA, 1410 nt, Artificial Sequence; identical to SEQ ID NO: 48139
  neuraminidase__InfluenzaA__ACZ17083

SEQ ID NO: 48215 - RNA, 1410 nt, Artificial Sequence
  neuraminidase__InfluenzaA__ACZ17093
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuugaaugcagaaccuucuucuugacucaaggggcccugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48216 - RNA, 1410 nt, Artificial Sequence
  neuraminidase__InfluenzaA__ACZ17113
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaacgacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48217 - RNA, 1410 nt, Artificial Sequence; identical to SEQ ID NO: 47242
  neuraminidase__InfluenzaA__ACZ17123

SEQ ID NO: 48218 - RNA, 1410 nt, Artificial Sequence; identical to SEQ ID NO: 47242
  neuraminidase__InfluenzaA__ACZ17133

SEQ ID NO: 48219 - RNA, 1410 nt, Artificial Sequence
  neuraminidase__InfluenzaA__ACZ17163
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccggaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48220 - RNA, 1410 nt, Artificial Sequence; identical to SEQ ID NO: 48219
  neuraminidase__InfluenzaA__ACZ17173

SEQ ID NO: 48221 - RNA, 1410 nt, Artificial Sequence
  neuraminidase__InfluenzaA__ACZ17183
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugccccguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccggaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48222 - RNA, 1410 nt, Artificial Sequence; identical to SEQ ID NO: 48221
  neuraminidase__InfluenzaA__ACZ17193

SEQ ID NO: 48223 - RNA, 1410 nt, Artificial Sequence; identical to SEQ ID NO: 48221
  neuraminidase__InfluenzaA__ACZ17203

SEQ ID NO: 48224 - RNA, 1410 nt, Artificial Sequence
  neuraminidase__InfluenzaA__ACZ17213
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguacccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48225 - RNA, 1410 nt, Artificial Sequence
  neuraminidase__InfluenzaA__ACZ17223
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48226 - RNA, 1410 nt, Artificial Sequence; identical to SEQ ID NO: 48225
  neuraminidase__InfluenzaA__ACZ17233

SEQ ID NO: 48227 - RNA, 1410 nt, Artificial Sequence; identical to SEQ ID NO: 48225
  neuraminidase__InfluenzaA__ACZ17243

SEQ ID NO: 48228 - RNA, 1410 nt, Artificial Sequence; identical to SEQ ID NO: 48225
  neuraminidase__InfluenzaA__ACZ17263

SEQ ID NO: 48229 - RNA, 1410 nt, Artificial Sequence
  neuraminidase__InfluenzaA__ACZ17273
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucggacccuaaugagcuguccuauuggugaaguucccucuccauacaacucaagauuugagucagucgcuuggucagcaagugcuugucaugauggcuucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguauugucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48230 - RNA, 1410 nt, Artificial Sequence; identical to SEQ ID NO: 47242
  neuraminidase__InfluenzaA__ACZ17283

SEQ ID NO: 48231 - RNA, 1410 nt, Artificial Sequence; identical to SEQ ID NO: 47272
  neuraminidase__InfluenzaA__ACZ17293

SEQ ID NO: 48232 - RNA, 1410 nt, Artificial Sequence; identical to SEQ ID NO: 47272
  neuraminidase__InfluenzaA__ACZ17303

SEQ ID NO: 48233 - RNA, 1410 nt, Artificial Sequence; identical to SEQ ID NO: 47272
  neuraminidase__InfluenzaA__ACZ17313

SEQ ID NO: 48234 - RNA, 1410 nt, Artificial Sequence; identical to SEQ ID NO: 47242
  neuraminidase__InfluenzaA__ACZ17401

SEQ ID NO: 48235 - RNA, 1410 nt, Artificial Sequence; identical to SEQ ID NO: 47242
  neuraminidase__InfluenzaA__ACZ17411

SEQ ID NO: 48236 - RNA, 1410 nt, Artificial Sequence; identical to SEQ ID NO: 47242
  neuraminidase__InfluenzaA__ACZ17421

SEQ ID NO: 48237 - RNA, 1410 nt, Artificial Sequence
  neuraminidase__InfluenzaA__ACZ17431
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaaaaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48238 - RNA, 1410 nt, Artificial Sequence
  neuraminidase__InfluenzaA__ACZ17441
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48239 - RNA, 1410 nt, Artificial Sequence
  neuraminidase__InfluenzaA__ACZ17451
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagagcuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48240 - RNA, 1410 nt, Artificial Sequence; identical to SEQ ID NO: 47242
  neuraminidase__InfluenzaA__ACZ17461

SEQ ID NO: 48241 - RNA, 1410 nt, Artificial Sequence; identical to SEQ ID NO: 47242
  neuraminidase__InfluenzaA__ACZ17471

SEQ ID NO: 48242 - RNA, 1410 nt, Artificial Sequence
  neuraminidase__InfluenzaA__ACZ17481
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguugguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggagaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48243 - RNA, 1410 nt, Artificial Sequence; identical to SEQ ID NO: 47242
  neuraminidase__InfluenzaA__ACZ17491

SEQ ID NO: 48244 - RNA, 1410 nt, Artificial Sequence
  neuraminidase__InfluenzaA__ACZ27803
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaaugguuuccgugaaauuagcgggcaauuccucucucugcccuguuaguggaugggcuauauacaguaaagacaacaguguaagaaucgguuccaagggggauguguuuaucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugcuccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48245 - RNA, 1410 nt, Artificial Sequence
  neuraminidase__InfluenzaA__ACZ27813
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggggacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48246 - RNA, 1410 nt, Artificial Sequence; identical to SEQ ID NO: 47439
  neuraminidase__InfluenzaA__ACZ27823

SEQ ID NO: 48247 - RNA, 1410 nt, Artificial Sequence
  neuraminidase__InfluenzaA__ACZ27833
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48248 - RNA, 1410 nt, Artificial Sequence; identical to SEQ ID NO: 47439
  neuraminidase__InfluenzaA__ACZ45022

SEQ ID NO: 48249 - RNA, 1410 nt, Artificial Sequence
  neuraminidase__InfluenzaA__ACZ53958
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauccggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggaggggaaaaucguucauacuagcucauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauguccugaugggucuguccucaaucucaugccuauauaa

SEQ ID NO: 48250 - RNA, 1410 nt, Artificial Sequence
  neuraminidase__InfluenzaA__ACZ53969
augaauccaaaucaaaagauaauaacgauuggcucuguuucucucaccauugccacaauaugcuuccuuaugcaaauugccauccugguaacuacuguaacauugcauuucaagcaauaugaaugcaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaauguaacauuacaggauuugcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaauuggguguuccauuucauuugggaaccaagcaagugugcauagcaugguccagcucaaguugucacgauggaaaagcauggcugcauguuuguguaacgggggaugaugaaaaugcaacugcuagcuucauuuacaaugggaggcuuguagauaguauugguucaugguccaaaaaaauccucaggacccaggagucggaaugcguuuguaucaauggaacuuguacaguaguaaugacugaugggagugcuucaggaaaagcugauacuaaaauacuauucauugaggagggggaaaucguucauacuagcccauugucaggaagugcucagcaugucgaggagugcuccuguuauccucgauauccuggugucagaugugucugcagagacaacuggaaaggcuccaauaggcccaucguagauauaaauguaaaggauuauagcauuguuuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaagucacgcucaggauaugaaaccuucaaagucauugaaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugaugggucuguccucaaucucaugccuauauaa

SEQ ID NO: 48251 - RNA, 1410 nt, Artificial Sequence
  neuraminidase__InfluenzaA__ACZ53980
augaauccaaaucaaaauaaauuaccgauuggcucuguuucucucaccauugccacaauaugcuuccuuaugcaaauugcaauccugaaaacuacuguaacauugcauuucaagcaauaugaaugcaacucccccccaaacaaccaagugaugcugugugaaccaacaauaauagaaagaaacuuaacaaagauuguguaucugaccaacaccaccauaaaaaaggaaauaugccccaaacaaccaaaauacagaaauuggucaaagccgaaauguaaaauuacagaauuggcaccuuuuucuaaggacaauucgauucggcuuuccgcugguggggacaucugggugacaagagaaccuuacgugucaugcgauccugacaaguguuaucaauuugcccuuggacagggaacaacacuaaacaacgggcauucaaaugacacaguacaugauaggaccccuuaucggacccuauugaugaaugaguuggguguuccauuucauuugggaaccaagcaagugugcauagcaugguccagcucaaguugucacgauggaaaagcauggcugcauguuuguaucacuggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaauuguccauauuagcccauugucaggaagugcucagcauguagaagaguguuccuguuauccuagauauccuggcgucagauguaucugcagagacaacuggaaaggcucuaauaggcccgucguagacauaaauauggaagauuauagcauugauuccaguuaugugugcucaggacuuguuggagacacacccagaaaaaacgacagcuccagcaguagccauugcuuggauccuaacaaugaggaagguggucauggagugaaaggcugggccuuugaugauggaaaugacguguggaugggaagaacgaucagcgagaaguuacgcucaggauaugaaaccuucaaagucauuggaggcugguccaaaccuaacuccaaauugcagauaaauaggcaagucauaguugacagagguaauagguccgguuauucugguauuuucucuguugaaggcaaaagcugcaucaaucggugcuuuuauguggaguugauaaggggaaggaaacaggaaacugaagucuuguggaccucaaacaguauuguuguguuuuguggcaccucagguacauauggaacaggcucauggccugaugggucuguccucaaucucaugccuauauaa

SEQ ID NO: 48252 - RNA, 1410 nt, Artificial Sequence; identical to SEQ ID NO: 47306
  neuraminidase__InfluenzaA__ACZ56082

SEQ ID NO: 48253 - RNA, 1410 nt, Artificial Sequence
  neuraminidase__InfluenzaA__ACZ57183
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48254 - RNA, 1413 nt, Artificial Sequence
  neuraminidase__InfluenzaA__ACZ81542
augaacccaaaucaaaagguuauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucuggcccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagaaggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48255 - RNA, 1413 nt, Artificial Sequence
  neuraminidase__InfluenzaA__ACZ81543
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacaacaccugggugaaucacacauauguuaauauuaacaacacuaauguuguugcuggagaggacaaaacaucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuacagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaagagcaaauauuaagaacacaagagucugaauguguuuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaacaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48256 - RNA, 1410 nt, Artificial Sequence
  neuraminidase__InfluenzaA__ACZ81546
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggaucugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacaugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48257 - RNA, 1410 nt, Artificial Sequence
  neuraminidase__InfluenzaA__ACZ81547
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaauauaacagagauaguguaucugaccaacaccaccauagagaaggaaauaugccccaaacuagcagaauacagaaauuggucaaaaccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacacaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacaaagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48258 - RNA, 1410 nt, Artificial Sequence; identical to SEQ ID NO: 47242
  neuraminidase__InfluenzaA__ACZ81634

SEQ ID NO: 48259 - RNA, 1410 nt, Artificial Sequence
  neuraminidase__InfluenzaA__ACZ81644
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48260 - RNA, 1410 nt, Artificial Sequence
  neuraminidase__InfluenzaA__ACZ81653
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48261 - RNA, 1410 nt, Artificial Sequence; identical to SEQ ID NO: 47242
  neuraminidase__InfluenzaA__ACZ95840

SEQ ID NO: 48262 - RNA, 1410 nt, Artificial Sequence
  neuraminidase__InfluenzaA__ACZ95850
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauuguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48263 - RNA, 1410 nt, Artificial Sequence
  neuraminidase__InfluenzaA__ACZ95860
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48264 - RNA, 1410 nt, Artificial Sequence
  neuraminidase__InfluenzaA__ACZ95870
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48265 - RNA, 1410 nt, Artificial Sequence; identical to SEQ ID NO: 47242
  neuraminidase__InfluenzaA__ACZ95880

SEQ ID NO: 48266 - RNA, 1410 nt, Artificial Sequence
  neuraminidase__InfluenzaA__ACZ95890
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauuccagugaaaucacaugugugugcagggacaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48267 - RNA, 1410 nt, Artificial Sequence; identical to SEQ ID NO: 47242
  neuraminidase__InfluenzaA__ACZ95900

SEQ ID NO: 48268 - RNA, 1410 nt, Artificial Sequence
  neuraminidase__InfluenzaA__ACZ95910
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48269 - RNA, 1410 nt, Artificial Sequence
  neuraminidase__InfluenzaA__ACZ95920
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48270 - RNA, 1410 nt, Artificial Sequence
  neuraminidase__InfluenzaA__ACZ95930
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48271 - RNA, 1410 nt, Artificial Sequence; identical to SEQ ID NO: 48269
  neuraminidase__InfluenzaA__ACZ95940

SEQ ID NO: 48272 - RNA, 1410 nt, Artificial Sequence
  neuraminidase__InfluenzaA__ACZ95950
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaacuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48273 - RNA, 1410 nt, Artificial Sequence
  neuraminidase__InfluenzaA__ACZ95960
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48274 - RNA, 1410 nt, Artificial Sequence; identical to SEQ ID NO: 48272
  neuraminidase__InfluenzaA__ACZ95970

SEQ ID NO: 48275 - RNA, 1410 nt, Artificial Sequence; identical to SEQ ID NO: 48269
  neuraminidase__InfluenzaA__ACZ95980

SEQ ID NO: 48276 - RNA, 1410 nt, Artificial Sequence
  neuraminidase__InfluenzaA__ACZ95990
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48277 - RNA, 1410 nt, Artificial Sequence
  neuraminidase__InfluenzaA__ACZ96000
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48278 - RNA, 1410 nt, Artificial Sequence
  neuraminidase__InfluenzaA__ACZ96010
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48279 - RNA, 1410 nt, Artificial Sequence
  neuraminidase__InfluenzaA__ACZ96020
augaauccaaaccaaaagauaauaaccauugguucggucugcaugacaauuggaauggcuaacuuaauauuacaaauuggaaacauaaucuuaauauggauuagccacucaauucaacuugggaaucaaaaucagacugaaacaugcaaucaaagcgucaucaccuacgaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48280 - RNA, 1410 nt, Artificial Sequence; identical to SEQ ID NO: 48269
  neuraminidase__InfluenzaA__ACZ96050

SEQ ID NO: 48281 - RNA, 1410 nt, Artificial Sequence; identical to SEQ ID NO: 47242
  neuraminidase__InfluenzaA__ACZ96060

SEQ ID NO: 48282 - RNA, 1410 nt, Artificial Sequence; identical to SEQ ID NO: 48278
  neuraminidase__InfluenzaA__ACZ96072

SEQ ID NO: 48283 - RNA, 1410 nt, Artificial Sequence
  neuraminidase__InfluenzaA__ACZ96082
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaauaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48284 - RNA, 1410 nt, Artificial Sequence; identical to SEQ ID NO: 48269
  neuraminidase__InfluenzaA__ACZ96092

SEQ ID NO: 48285 - RNA, 1410 nt, Artificial Sequence
  neuraminidase__InfluenzaA__ACZ96102
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaacauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaaaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48286 - RNA, 1410 nt, Artificial Sequence
  neuraminidase__InfluenzaA__ACZ96112
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48287 - RNA, 1410 nt, Artificial Sequence
  neuraminidase__InfluenzaA__ACZ96122
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaagcaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggaaagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguauaaacagugacacuguggguuggucuuggccagacggugcugaguugccauuuaccauugacaaguaa

SEQ ID NO: 48288 - RNA, 1410 nt, Artificial Sequence; identical to SEQ ID NO: 47242
  neuraminidase__InfluenzaA__ACZ96132

SEQ ID NO: 48289 - RNA, 1410 nt, Artificial Sequence; identical to SEQ ID NO: 47306
  neuraminidase__InfluenzaA__ACZ96142

SEQ ID NO: 48290 - RNA, 1410 nt, Artificial Sequence
  neuraminidase__InfluenzaA__ACZ96152
augaauccaaaccaaaagauaauaaccauugguucggucuguaugacaauuggaauggcuaacuuaauauuacaaauuggaaacauaauaucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48291 - RNA, 1410 nt, Artificial Sequence; identical to SEQ ID NO: 48277
  neuraminidase__InfluenzaA__ACZ96162

SEQ ID NO: 48292 - RNA, 1410 nt, Artificial Sequence; identical to SEQ ID NO: 47306
  neuraminidase__InfluenzaA__ACZ96172

SEQ ID NO: 48293 - RNA, 1410 nt, Artificial Sequence
  neuraminidase__InfluenzaA__ACZ96182
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacagacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48294 - RNA, 1410 nt, Artificial Sequence
  neuraminidase__InfluenzaA__ACZ96192
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcucuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48295 - RNA, 1410 nt, Artificial Sequence
  neuraminidase__InfluenzaA__ACZ96232
augaauccaaaccaaaagauaauaaccauugguucggucuguaugacaguuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaugacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48296 - RNA, 1410 nt, Artificial Sequence
  neuraminidase__InfluenzaA__ACZ96242
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagagcacaaucuggacuagcgggagcagcauauccuuuugugguguaaacagugacacuguggguuggucuuggccagacggugcugaguugccauuuaccauugacaaguaa

SEQ ID NO: 48297 - RNA, 1410 nt, Artificial Sequence; identical to SEQ ID NO: 48278
  neuraminidase__InfluenzaA__ACZ96252

SEQ ID NO: 48298 - RNA, 1410 nt, Artificial Sequence; identical to SEQ ID NO: 48273
  neuraminidase__InfluenzaA__ACZ96292

SEQ ID NO: 48299 - RNA, 1410 nt, Artificial Sequence
  neuraminidase__InfluenzaA__ACZ96302
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucggucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48300 - RNA, 1410 nt, Artificial Sequence; identical to SEQ ID NO: 47689
  neuraminidase__InfluenzaA__ACZ96312

SEQ ID NO: 48301 - RNA, 1410 nt, Artificial Sequence
  neuraminidase__InfluenzaA__ACZ96322
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuaacgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48302 - RNA, 1410 nt, Artificial Sequence; identical to SEQ ID NO: 48301
  neuraminidase__InfluenzaA__ACZ96332

SEQ ID NO: 48303 - RNA, 1410 nt, Artificial Sequence
  neuraminidase__InfluenzaA__ACZ96352
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaacuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaacuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48304 - RNA, 1410 nt, Artificial Sequence; identical to SEQ ID NO: 48301
  neuraminidase__InfluenzaA__ACZ96362

SEQ ID NO: 48305 - RNA, 1410 nt, Artificial Sequence
  neuraminidase__InfluenzaA__ACZ96375
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48306 - RNA, 1410 nt, Artificial Sequence; identical to SEQ ID NO: 48301
  neuraminidase__InfluenzaA__ACZ96385

SEQ ID NO: 48307 - RNA, 1410 nt, Artificial Sequence
  neuraminidase__InfluenzaA__ACZ96395
augaauccaaaccaaaagauaauaaccauugguucggucugcaugacaauuggaauggcuaacuuaauauuacaaauuggaaacauaaucucaauauggauuagccacucaauucaacuugggaaucaaaaucagacugaaacaugcaaucaaagcgucaucaccuacgaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuauugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48308 - RNA, 1410 nt, Artificial Sequence; identical to SEQ ID NO: 48286
  neuraminidase__InfluenzaA__ACZ96408

SEQ ID NO: 48309 - RNA, 1410 nt, Artificial Sequence; identical to SEQ ID NO: 47242
  neuraminidase__InfluenzaA__ACZ96428

SEQ ID NO: 48310 - RNA, 1410 nt, Artificial Sequence; identical to SEQ ID NO: 47242
  neuraminidase__InfluenzaA__ACZ96438

SEQ ID NO: 48311 - RNA, 1410 nt, Artificial Sequence
  neuraminidase__InfluenzaA__ACZ96448
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 48312 - RNA, 1410 nt, Artificial Sequence; identical to SEQ ID NO: 47242
  neuraminidase__InfluenzaA__ACZ96479

SEQ ID NO: 48313 - RNA, 1410 nt, Artificial Sequence; identical to SEQ ID NO: 48272
  neuraminidase__InfluenzaA__ACZ96489

SEQ ID NO: 48314 - RNA, 1410 nt, Artificial Sequence
  neuraminidase__InfluenzaA__ACZ96499
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaauaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48315 - RNA, 1410 nt, Artificial Sequence
  neuraminidase__InfluenzaA__ACZ96509
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggauaaaccaaacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48316 - RNA, 1410 nt, Artificial Sequence; identical to SEQ ID NO: 47242
  neuraminidase__InfluenzaA__ACZ96519

SEQ ID NO: 48317 - RNA, 1410 nt, Artificial Sequence
  neuraminidase__InfluenzaA__ACZ96529
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccaucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugacugauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48318 - RNA, 1410 nt, Artificial Sequence
  neuraminidase__InfluenzaA__ACZ96552
augaauccaaaccaaaagauaauaaccauugguucggucuguaugacaauuggaauggcuaacuuaauauuacaaauuggaaacauaaucucaauauggauuagccacucaagucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48319 - RNA, 1410 nt, Artificial Sequence
  neuraminidase__InfluenzaA__ACZ96562
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48320 - RNA, 1410 nt, Artificial Sequence; identical to SEQ ID NO: 48286
  neuraminidase__InfluenzaA__ACZ96572

SEQ ID NO: 48321 - RNA, 1410 nt, Artificial Sequence; identical to SEQ ID NO: 47242
  neuraminidase__InfluenzaA__ACZ96582

SEQ ID NO: 48322 - RNA, 1410 nt, Artificial Sequence
  neuraminidase__InfluenzaA__ACZ96592
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaguccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaauuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48323 - RNA, 1410 nt, Artificial Sequence; identical to SEQ ID NO: 47306
  neuraminidase__InfluenzaA__ACZ96602

SEQ ID NO: 48324 - RNA, 1410 nt, Artificial Sequence
  neuraminidase__InfluenzaA__ACZ96612
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucguuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagauaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48325 - RNA, 1410 nt, Artificial Sequence; identical to SEQ ID NO: 47272
  neuraminidase__InfluenzaA__ACZ96622

SEQ ID NO: 48326 - RNA, 1410 nt, Artificial Sequence; identical to SEQ ID NO: 47272
  neuraminidase__InfluenzaA__ACZ96632

SEQ ID NO: 48327 - RNA, 1410 nt, Artificial Sequence; identical to SEQ ID NO: 47272
  neuraminidase__InfluenzaA__ACZ96642

SEQ ID NO: 48328 - RNA, 1410 nt, Artificial Sequence; identical to SEQ ID NO: 47272
  neuraminidase__InfluenzaA__ACZ96652

SEQ ID NO: 48329 - RNA, 1410 nt, Artificial Sequence; identical to SEQ ID NO: 47272
  neuraminidase__InfluenzaA__ACZ96662

SEQ ID NO: 48330 - RNA, 1410 nt, Artificial Sequence; identical to SEQ ID NO: 47272
  neuraminidase__InfluenzaA__ACZ96672

SEQ ID NO: 48331 - RNA, 1410 nt, Artificial Sequence; identical to SEQ ID NO: 47272
  neuraminidase__InfluenzaA__ACZ96682

SEQ ID NO: 48332 - RNA, 1410 nt, Artificial Sequence; identical to SEQ ID NO: 47272
  neuraminidase__InfluenzaA__ACZ96692

SEQ ID NO: 48333 - RNA, 1410 nt, Artificial Sequence; identical to SEQ ID NO: 47272
  neuraminidase__InfluenzaA__ACZ96702

SEQ ID NO: 48334 - RNA, 1410 nt, Artificial Sequence; identical to SEQ ID NO: 47272
  neuraminidase__InfluenzaA__ACZ96712

SEQ ID NO: 48335 - RNA, 1410 nt, Artificial Sequence; identical to SEQ ID NO: 47272
  neuraminidase__InfluenzaA__ACZ96722

SEQ ID NO: 48336 - RNA, 1410 nt, Artificial Sequence; identical to SEQ ID NO: 47272
  neuraminidase__InfluenzaA__ACZ96732

SEQ ID NO: 48337 - RNA, 1410 nt, Artificial Sequence; identical to SEQ ID NO: 47272
  neuraminidase__InfluenzaA__ACZ96742

SEQ ID NO: 48338 - RNA, 1410 nt, Artificial Sequence
  neuraminidase__InfluenzaA__ACZ96752
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagagaaccguucauaucaugcucccccuuggaaugcagaaccuucuucuugacucaaggagccuugcuaaaugacaaacauuccaauggaaccauuaaagacaggagcccauaucgaaccuuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48339 - RNA, 1410 nt, Artificial Sequence; identical to SEQ ID NO: 47241
  neuraminidase__InfluenzaA__ACZ96762

SEQ ID NO: 48340 - RNA, 1410 nt, Artificial Sequence; identical to SEQ ID NO: 47241
  neuraminidase__InfluenzaA__ACZ96772

SEQ ID NO: 48341 - RNA, 1410 nt, Artificial Sequence
  neuraminidase__InfluenzaA__ACZ96782
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagagaaccguucauaucaugcucccccuuggaaugcagaaccuucuucuugacucaaggagccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48342 - RNA, 1410 nt, Artificial Sequence
  neuraminidase__InfluenzaA__ACZ96792
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagagaaccguucauaucaugcucccccuuggaaugcagaaccuuuuucuugacucaaggagccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48343 - RNA, 1410 nt, Artificial Sequence; identical to SEQ ID NO: 47242
  neuraminidase__InfluenzaA__ACZ96802

SEQ ID NO: 48344 - RNA, 1410 nt, Artificial Sequence; identical to SEQ ID NO: 47242
  neuraminidase__InfluenzaA__ACZ96812

SEQ ID NO: 48345 - RNA, 1410 nt, Artificial Sequence
  neuraminidase__InfluenzaA__ACZ96822
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagagcuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugggcuggucuuggccagacggugcugaguugccauuuaccauugacaaguaa

SEQ ID NO: 48346 - RNA, 1410 nt, Artificial Sequence
  neuraminidase__InfluenzaA__ACZ96842
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagagaaccguucauaucaugcucccccuuggaaugcagaaccuucuucuugacucaaggagccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugauugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48347 - RNA, 1410 nt, Artificial Sequence; identical to SEQ ID NO: 48263
  neuraminidase__InfluenzaA__ACZ96852

SEQ ID NO: 48348 - RNA, 1410 nt, Artificial Sequence; identical to SEQ ID NO: 47242
  neuraminidase__InfluenzaA__ACZ96862

SEQ ID NO: 48349 - RNA, 1410 nt, Artificial Sequence
  neuraminidase__InfluenzaA__ACZ96872
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugcgcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48350 - RNA, 1410 nt, Artificial Sequence
  neuraminidase__InfluenzaA__ACZ96882
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagagcuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugggcuggucuuggccagacggugcugaguugccauuuaccauugacaaguaa

SEQ ID NO: 48351 - RNA, 1410 nt, Artificial Sequence; identical to SEQ ID NO: 48349
  neuraminidase__InfluenzaA__ACZ96892

SEQ ID NO: 48352 - RNA, 1410 nt, Artificial Sequence; identical to SEQ ID NO: 48349
  neuraminidase__InfluenzaA__ACZ96902

SEQ ID NO: 48353 - RNA, 1410 nt, Artificial Sequence
  neuraminidase__InfluenzaA__ACZ96912
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagggggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48354 - RNA, 1410 nt, Artificial Sequence; identical to SEQ ID NO: 48353
  neuraminidase__InfluenzaA__ACZ96922

SEQ ID NO: 48355 - RNA, 1410 nt, Artificial Sequence
  neuraminidase__InfluenzaA__ACZ96932
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaauuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48356 - RNA, 1410 nt, Artificial Sequence; identical to SEQ ID NO: 48355
  neuraminidase__InfluenzaA__ACZ96942

SEQ ID NO: 48357 - RNA, 1410 nt, Artificial Sequence; identical to SEQ ID NO: 47241
  neuraminidase__InfluenzaA__ACZ96952

SEQ ID NO: 48358 - RNA, 1410 nt, Artificial Sequence; identical to SEQ ID NO: 47241
  neuraminidase__InfluenzaA__ACZ97024

SEQ ID NO: 48359 - RNA, 1410 nt, Artificial Sequence; identical to SEQ ID NO: 48355
  neuraminidase__InfluenzaA__ACZ97336

SEQ ID NO: 48360 - RNA, 1410 nt, Artificial Sequence; identical to SEQ ID NO: 48349
  neuraminidase__InfluenzaA__ACZ97346

SEQ ID NO: 48361 - RNA, 1410 nt, Artificial Sequence; identical to SEQ ID NO: 47562
  neuraminidase__InfluenzaA__ACZ97366

SEQ ID NO: 48362 - RNA, 1410 nt, Artificial Sequence; identical to SEQ ID NO: 47562
  neuraminidase__InfluenzaA__ACZ97376

SEQ ID NO: 48363 - RNA, 1410 nt, Artificial Sequence; identical to SEQ ID NO: 47562
  neuraminidase__InfluenzaA__ACZ97386

SEQ ID NO: 48364 - RNA, 1410 nt, Artificial Sequence; identical to SEQ ID NO: 48355
  neuraminidase__InfluenzaA__ACZ97396

SEQ ID NO: 48365 - RNA, 1410 nt, Artificial Sequence; identical to SEQ ID NO: 47242
  neuraminidase__InfluenzaA__ACZ98171

SEQ ID NO: 48366 - RNA, 1410 nt, Artificial Sequence
  neuraminidase__InfluenzaA__ACZ98181
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 48367 - RNA, 1410 nt, Artificial Sequence
  neuraminidase__InfluenzaA__ACZ98191
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuaguuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuuaacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgguaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48368 - RNA, 1410 nt, Artificial Sequence; identical to SEQ ID NO: 47241
  neuraminidase__InfluenzaA__ACZ98201

SEQ ID NO: 48369 - RNA, 1410 nt, Artificial Sequence; identical to SEQ ID NO: 47242
  neuraminidase__InfluenzaA__ACZ98211

SEQ ID NO: 48370 - RNA, 1410 nt, Artificial Sequence; identical to SEQ ID NO: 47796
  neuraminidase__InfluenzaA__ACZ98221

SEQ ID NO: 48371 - RNA, 1410 nt, Artificial Sequence
  neuraminidase__InfluenzaA__ACZ98231
augaauccaaaccaaaagauaauaaccauugguucggucuguaugacaauuggaauggcuaacuuaauauuacaaauugggaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48372 - RNA, 1410 nt, Artificial Sequence; identical to SEQ ID NO: 47242
  neuraminidase__InfluenzaA__ACZ98241

SEQ ID NO: 48373 - RNA, 1410 nt, Artificial Sequence; identical to SEQ ID NO: 48219
  neuraminidase__InfluenzaA__ACZ98251

SEQ ID NO: 48374 - RNA, 1410 nt, Artificial Sequence
  neuraminidase__InfluenzaA__ACZ98261
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaacggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48375 - RNA, 1410 nt, Artificial Sequence; identical to SEQ ID NO: 48225
  neuraminidase__InfluenzaA__ACZ98271

SEQ ID NO: 48376 - RNA, 1410 nt, Artificial Sequence; identical to SEQ ID NO: 48263
  neuraminidase__InfluenzaA__ACZ98281

SEQ ID NO: 48377 - RNA, 1410 nt, Artificial Sequence; identical to SEQ ID NO: 48263
  neuraminidase__InfluenzaA__ACZ98291

SEQ ID NO: 48378 - RNA, 1410 nt, Artificial Sequence
  neuraminidase__InfluenzaA__ACZ98301
augaauccaaaccaaaagauaauaaccauugguucggucuguaugacaauuggaauggcuaacuuaauauuacaaauuggaaacauaauuucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacaccaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacgggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48379 - RNA, 1410 nt, Artificial Sequence
  neuraminidase__InfluenzaA__ACZ98321
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48380 - RNA, 1410 nt, Artificial Sequence; identical to SEQ ID NO: 48286
  neuraminidase__InfluenzaA__ACZ98331

SEQ ID NO: 48381 - RNA, 1410 nt, Artificial Sequence
  neuraminidase__InfluenzaA__ACZ98341
augaauccaaaccaaaagauaauaaccauugguucggucuguauuacaauuggaauggcuaacuuaauauuacaaauuggaaacauaaucucaauauggauuagccacccaauucaacuugggaaucaaaaucagauugaaacaugcaaucaaagcgucauuacuuaugaaaacaacacuuggguaaaucagacauaugucaacaucagcaacaccaaccuugcugcuggacagucagugguuuccgugaaauuagcgggcaauuccucucucugcccugucaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48382 - RNA, 1410 nt, Artificial Sequence; identical to SEQ ID NO: 48263
  neuraminidase__InfluenzaA__ACZ98351

SEQ ID NO: 48383 - RNA, 1410 nt, Artificial Sequence; identical to SEQ ID NO: 47242
  neuraminidase__InfluenzaA__ACZ98361

SEQ ID NO: 48384 - RNA, 1410 nt, Artificial Sequence; identical to SEQ ID NO: 47242
  neuraminidase__InfluenzaA__ACZ98371

SEQ ID NO: 48385 - RNA, 1410 nt, Artificial Sequence; identical to SEQ ID NO: 47439
  neuraminidase__InfluenzaA__ACZ98381

SEQ ID NO: 48386 - RNA, 1410 nt, Artificial Sequence; identical to SEQ ID NO: 47242
  neuraminidase__InfluenzaA__ACZ98391

SEQ ID NO: 48387 - RNA, 1410 nt, Artificial Sequence; identical to SEQ ID NO: 47242
  neuraminidase__InfluenzaA__ACZ98401

SEQ ID NO: 48388 - RNA, 1410 nt, Artificial Sequence; identical to SEQ ID NO: 47242
  neuraminidase__InfluenzaA__ACZ98411

SEQ ID NO: 48389 - RNA, 1410 nt, Artificial Sequence; identical to SEQ ID NO: 47272
  neuraminidase__InfluenzaA__ACZ98421

SEQ ID NO: 48390 - RNA, 1410 nt, Artificial Sequence; identical to SEQ ID NO: 47242
  neuraminidase__InfluenzaA__ACZ98431

SEQ ID NO: 48391 - RNA, 1410 nt, Artificial Sequence; identical to SEQ ID NO: 47242
  neuraminidase__InfluenzaA__ACZ98441

SEQ ID NO: 48392 - RNA, 1410 nt, Artificial Sequence; identical to SEQ ID NO: 47242
  neuraminidase__InfluenzaA__ACZ98451

SEQ ID NO: 48393 - RNA, 1410 nt, Artificial Sequence; identical to SEQ ID NO: 48263
  neuraminidase__InfluenzaA__ACZ98461

SEQ ID NO: 48394 - RNA, 1410 nt, Artificial Sequence; identical to SEQ ID NO: 48345
  neuraminidase__InfluenzaA__ACZ98674

SEQ ID NO: 48395 - RNA, 1410 nt, Artificial Sequence; identical to SEQ ID NO: 48355
  neuraminidase__InfluenzaA__ACZ98684

SEQ ID NO: 48396 - RNA, 1410 nt, Artificial Sequence; identical to SEQ ID NO: 48295
  neuraminidase__InfluenzaA__ACZ98694

SEQ ID NO: 48397 - RNA, 1410 nt, Artificial Sequence
  neuraminidase__InfluenzaA__ADA60801
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaccuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48398 - RNA, 1410 nt, Artificial Sequence; identical to SEQ ID NO: 47242
  neuraminidase__InfluenzaA__ADA69294

SEQ ID NO: 48399 - RNA, 1410 nt, Artificial Sequence; identical to SEQ ID NO: 47242
  neuraminidase__InfluenzaA__ADA69304

SEQ ID NO: 48400 - RNA, 1410 nt, Artificial Sequence; identical to SEQ ID NO: 47242
  neuraminidase__InfluenzaA__ADA69314

SEQ ID NO: 48401 - RNA, 1410 nt, Artificial Sequence; identical to SEQ ID NO: 47242
  neuraminidase__InfluenzaA__ADA69324

SEQ ID NO: 48402 - RNA, 1410 nt, Artificial Sequence; identical to SEQ ID NO: 47242
  neuraminidase__InfluenzaA__ADA69334

SEQ ID NO: 48403 - RNA, 1410 nt, Artificial Sequence
  neuraminidase__InfluenzaA__ADA69451
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguaucagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48404 - RNA, 1410 nt, Artificial Sequence
  neuraminidase__InfluenzaA__ADA69453
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48405 - RNA, 1410 nt, Artificial Sequence
  neuraminidase__InfluenzaA__ADA71153
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccauuguagauauaaacauaaaggaucauagcauuguuucccguuauguguguucaggacuuguuggagacccacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 48406 - RNA, 1413 nt, Artificial Sequence
  neuraminidase__InfluenzaA__ADA71155
augaacccaaaucaaaagauaauaaccauuggaucaaucaguauagcaaucgggauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucacacauauguuaauauuaacaacacuaaaguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuuuaccauaaugaccgauggcccgaguaauaaggccgccucuuacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggauacagcgggaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48407 - RNA, 1413 nt, Artificial Sequence
  neuraminidase__InfluenzaA__ADA71157
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacauuugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48408 - RNA, 1413 nt, Artificial Sequence
  neuraminidase__InfluenzaA__ADA71159
augaacccaaaucaaaagauaauaaccauuggaucaaucaguauagcaaucgggauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucacacauauguuaauauuaacaacacuaaaguuguugcuggagagggcaaaacuucagugacauuggccggcaauucaucucuuuguucuaucaguggaugggcuauaaacacaaaagacaacagcauaagaauuggcuccaaaggagauguuuuugucauaagagaaccuuucauaucauguucucacuuggaaugcagaaccuuuuuucugacccaaggcgcacuauuaaaugacaaacauucaaauaggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuuuaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggauacagcgggaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48409 - RNA, 1410 nt, Artificial Sequence
  neuraminidase__InfluenzaA__ADA71161
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcgucuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcucuugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaacuuucaaagucauugaaggcugguccaaccauaaguccaaauugcagauaaauaggcaagucauaguugacagagguaauagguccgguuauucugguauuuucucuguugaaggcaaaagcugcaucaaucggugcuuuuauguggaguugauuaggggaagaaaagaggaaacugaagucuuguggaccucaaacaguauuguuguguuuuguggcaccucagguacauauggaacaggcucauggccugauggggcggaccucaaucucaugccuauauaa

SEQ ID NO: 48410 - RNA, 1413 nt, Artificial Sequence
  neuraminidase__InfluenzaA__ADA71165
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuccaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48411 - RNA, 1410 nt, Artificial Sequence
  neuraminidase__InfluenzaA__ADA71167
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcuggcggggacaucugggugacaagagaaccuuaugugucaugcgauccugacaaguguuaucaauuugcccuuggacagggaacaacacuaaacaacgugcauucaaauaacacaguacgugguaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguggauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 48412 - RNA, 1413 nt, Artificial Sequence
  neuraminidase__InfluenzaA__ADA71169
augaacccaaaucaaaaaauaauaaccauuggaucaaucaguauagcaaucggaauaauuagucuaauguugcaaauaggaaauauuauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcuccaaaggagauguuuuugucauaagagaaccuuucauaucaugcucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguauaaacgggucauguuucaccauaaugaccgaugguccgagugauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauggagagggcagcugcaacccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 48413 - RNA, 1413 nt, Artificial Sequence
  neuraminidase__InfluenzaA__ADA71171
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaaggacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48414 - RNA, 1410 nt, Artificial Sequence
  neuraminidase__InfluenzaA__ADA71173
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaauaacacaguacgugcuaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuugaauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaauugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 48415 - RNA, 1413 nt, Artificial Sequence
  neuraminidase__InfluenzaA__ADA71175
augaacccaaaucaaaagauaauaaccauuggaucaaucaguauagcaaucgggauaauuagucuaauguugcaaauaggaaauauuauuucaauaugggcuagucacucaauccaaauuggaagucaaaacaacacuggaauaugcaaccaaagaaucaucacauaugaaaacagcaccugggugaaucacacauauguuaauauuaacaacacuaaaguuguugcuggagaggacaaaacuucagugacauuggccggcaauucaucucuuuguucuaucaguggaugggcuauaaacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuuuaccauaaugaccgauggcccgaguaauaaggccgccucguacaaaauuuucaagaucgaaaaagggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugggguuuggauaggaaggaccaaaaguaacagacuuagaaagggguuugagaugauuugggauccuaauggauggacaaauaccgacagugauuucucagugaaacaggauguuguagcaauaacugauuggucaggauacagcgggaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccaucgacaaguag

SEQ ID NO: 48416 - RNA, 1413 nt, Artificial Sequence
  neuraminidase__InfluenzaA__ADA71177
augaacccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacauuugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48417 - RNA, 1410 nt, Artificial Sequence
  neuraminidase__InfluenzaA__ADA71193
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48418 - RNA, 1410 nt, Artificial Sequence
  neuraminidase__InfluenzaA__ADA79589
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaguuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaagucaagauuugagucagucgcuuggucagcaagugcuugucaugauggcaucaauuggcuaacaauuggaauuucuggcccagacaauggggcaguggcuguguuaaaguauaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48419 - RNA, 1410 nt, Artificial Sequence
  neuraminidase__InfluenzaA__ADA79599
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48420 - RNA, 1410 nt, Artificial Sequence
  neuraminidase__InfluenzaA__ADA79609
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccaugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48421 - RNA, 1410 nt, Artificial Sequence
  neuraminidase__InfluenzaA__ADA79619
augaauccaaaccaaaagauaauaaccauugguucgaucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguggccuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48422 - RNA, 1410 nt, Artificial Sequence; identical to SEQ ID NO: 47439
  neuraminidase__InfluenzaA__ADA81211

SEQ ID NO: 48423 - RNA, 1410 nt, Artificial Sequence
  neuraminidase__InfluenzaA__ADA83035
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcaguaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48424 - RNA, 1410 nt, Artificial Sequence
  neuraminidase__InfluenzaA__ADA83037
augaauccaaaccaaaagauaauaaccauugguucggucuguaugacaauuggaauggcuaacuuaauauuacaaauuggaaacauaaucucgauauggauuagccacucaauucaacuugggaaucaagaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48425 - RNA, 1410 nt, Artificial Sequence; identical to SEQ ID NO: 47242
  neuraminidase__InfluenzaA__ADA83588

SEQ ID NO: 48426 - RNA, 1410 nt, Artificial Sequence; identical to SEQ ID NO: 47975
  neuraminidase__InfluenzaA__ADA83592

SEQ ID NO: 48427 - RNA, 1410 nt, Artificial Sequence; identical to SEQ ID NO: 47242
  neuraminidase__InfluenzaA__ADA83596

SEQ ID NO: 48428 - RNA, 1410 nt, Artificial Sequence; identical to SEQ ID NO: 47318
  neuraminidase__InfluenzaA__ADA83600

SEQ ID NO: 48429 - RNA, 1410 nt, Artificial Sequence; identical to SEQ ID NO: 47242
  neuraminidase__InfluenzaA__ADA83604

SEQ ID NO: 48430 - RNA, 1410 nt, Artificial Sequence
  neuraminidase__InfluenzaA__ADA83608
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48431 - RNA, 1410 nt, Artificial Sequence
  neuraminidase__InfluenzaA__ADA83612
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugaugggcaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48432 - RNA, 1410 nt, Artificial Sequence
  neuraminidase__InfluenzaA__ADA83616
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugaugggcaggccucguacaagaucuucagaauagaaaagggaaagauagucaaaucagucgaaaugaaugccccuaauuauuacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48433 - RNA, 1410 nt, Artificial Sequence; identical to SEQ ID NO: 48430
  neuraminidase__InfluenzaA__ADA83624

SEQ ID NO: 48434 - RNA, 1410 nt, Artificial Sequence; identical to SEQ ID NO: 47242
  neuraminidase__InfluenzaA__ADA83630

SEQ ID NO: 48435 - RNA, 1410 nt, Artificial Sequence
  neuraminidase__InfluenzaA__ADA83634
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcaugguucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48436 - RNA, 1410 nt, Artificial Sequence
  neuraminidase__InfluenzaA__ADA83638
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugaugggcaggccucguacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48437 - RNA, 1410 nt, Artificial Sequence; identical to SEQ ID NO: 47242
  neuraminidase__InfluenzaA__ADA83642

SEQ ID NO: 48438 - RNA, 1410 nt, Artificial Sequence; identical to SEQ ID NO: 47242
  neuraminidase__InfluenzaA__ADA83649

SEQ ID NO: 48439 - RNA, 1410 nt, Artificial Sequence; identical to SEQ ID NO: 48436
  neuraminidase__InfluenzaA__ADA83653

SEQ ID NO: 48440 - RNA, 1410 nt, Artificial Sequence
  neuraminidase__InfluenzaA__ADA83657
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugaugggcaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48441 - RNA, 1410 nt, Artificial Sequence
  neuraminidase__InfluenzaA__ADA83661
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagaaaacacaaucuggacuagcgggagcagcauauccuuuugugguguaaacagugacacuguggguuggucuuggccagacggugcugaguugccauuuaccauugacaaguaa

SEQ ID NO: 48442 - RNA, 1410 nt, Artificial Sequence; identical to SEQ ID NO: 47242
  neuraminidase__InfluenzaA__ADA83669

SEQ ID NO: 48443 - RNA, 1410 nt, Artificial Sequence; identical to SEQ ID NO: 47242
  neuraminidase__InfluenzaA__ADA83673

SEQ ID NO: 48444 - RNA, 1410 nt, Artificial Sequence
  neuraminidase__InfluenzaA__ADA83677
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcaugguucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48445 - RNA, 1410 nt, Artificial Sequence; identical to SEQ ID NO: 48435
  neuraminidase__InfluenzaA__ADA83681

SEQ ID NO: 48446 - RNA, 1410 nt, Artificial Sequence
  neuraminidase__InfluenzaA__ADA83685
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcuggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucaagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48447 - RNA, 1410 nt, Artificial Sequence
  neuraminidase__InfluenzaA__ADA86069
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48448 - RNA, 1410 nt, Artificial Sequence; identical to SEQ ID NO: 47439
  neuraminidase__InfluenzaA__ADB27973

SEQ ID NO: 48449 - RNA, 1410 nt, Artificial Sequence; identical to SEQ ID NO: 47439
  neuraminidase__InfluenzaA__ADB27983

SEQ ID NO: 48450 - RNA, 1410 nt, Artificial Sequence
  neuraminidase__InfluenzaA__ADB66693
augaauccaaaccaaaagauaauaaccauugguucggucuguaugacaauuggaauggcuaacuuaauauuacaaauuggaaacauaaucucaauauggauuauccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48451 - RNA, 1410 nt, Artificial Sequence; identical to SEQ ID NO: 47242
  neuraminidase__InfluenzaA__ADB66695

SEQ ID NO: 48452 - RNA, 1410 nt, Artificial Sequence
  neuraminidase__InfluenzaA__ADB66696
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaauuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48453 - RNA, 1410 nt, Artificial Sequence
  neuraminidase__InfluenzaA__ADB66697
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacagcauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugaugaacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauacaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48454 - RNA, 1410 nt, Artificial Sequence; identical to SEQ ID NO: 48417
  neuraminidase__InfluenzaA__ADB81401

SEQ ID NO: 48455 - RNA, 1410 nt, Artificial Sequence
  neuraminidase__InfluenzaA__ADB81421
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48456 - RNA, 1410 nt, Artificial Sequence
  neuraminidase__InfluenzaA__ADB81431
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggaauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48457 - RNA, 1410 nt, Artificial Sequence
  neuraminidase__InfluenzaA__ADB81441
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaggauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48458 - RNA, 1410 nt, Artificial Sequence
  neuraminidase__InfluenzaA__ADB81451
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaauguguauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48459 - RNA, 1410 nt, Artificial Sequence; identical to SEQ ID NO: 48419
  neuraminidase__InfluenzaA__ADB81461

SEQ ID NO: 48460 - RNA, 1410 nt, Artificial Sequence; identical to SEQ ID NO: 48419
  neuraminidase__InfluenzaA__ADB82942

SEQ ID NO: 48461 - RNA, 1410 nt, Artificial Sequence
  neuraminidase__InfluenzaA__ADB82945
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48462 - RNA, 1410 nt, Artificial Sequence
  neuraminidase__InfluenzaA__ADB89132
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48463 - RNA, 1410 nt, Artificial Sequence
  neuraminidase__InfluenzaA__ADB89142
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48464 - RNA, 1410 nt, Artificial Sequence; identical to SEQ ID NO: 47445
  neuraminidase__InfluenzaA__ADB89224

SEQ ID NO: 48465 - RNA, 1410 nt, Artificial Sequence
  neuraminidase__InfluenzaA__ADB89234
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48466 - RNA, 1410 nt, Artificial Sequence; identical to SEQ ID NO: 47276
  neuraminidase__InfluenzaA__ADB89244

SEQ ID NO: 48467 - RNA, 1410 nt, Artificial Sequence; identical to SEQ ID NO: 47306
  neuraminidase__InfluenzaA__ADB89264

SEQ ID NO: 48468 - RNA, 1410 nt, Artificial Sequence
  neuraminidase__InfluenzaA__ADB89274
augaauccaaaccaaaagauaauaaccauugguucggucuguaugacaauuggaauggcuaacuuaauauuacaaauuggaaacauaaucucaauauggauuagccacucaauucaacuuggggaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuuuuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48469 - RNA, 1410 nt, Artificial Sequence; identical to SEQ ID NO: 47397
  neuraminidase__InfluenzaA__ADB89284

SEQ ID NO: 48470 - RNA, 1410 nt, Artificial Sequence; identical to SEQ ID NO: 48036
  neuraminidase__InfluenzaA__ADB89294

SEQ ID NO: 48471 - RNA, 1410 nt, Artificial Sequence
  neuraminidase__InfluenzaA__ADB89304
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaagggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48472 - RNA, 1410 nt, Artificial Sequence
  neuraminidase__InfluenzaA__ADB89314
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaaggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48473 - RNA, 1410 nt, Artificial Sequence; identical to SEQ ID NO: 47242
  neuraminidase__InfluenzaA__ADB89324

SEQ ID NO: 48474 - RNA, 1410 nt, Artificial Sequence; identical to SEQ ID NO: 47242
  neuraminidase__InfluenzaA__ADB89334

SEQ ID NO: 48475 - RNA, 1410 nt, Artificial Sequence; identical to SEQ ID NO: 47242
  neuraminidase__InfluenzaA__ADB89344

SEQ ID NO: 48476 - RNA, 1410 nt, Artificial Sequence; identical to SEQ ID NO: 47242
  neuraminidase__InfluenzaA__ADB89364

SEQ ID NO: 48477 - RNA, 1410 nt, Artificial Sequence
  neuraminidase__InfluenzaA__ADB89374
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacgguauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48478 - RNA, 1410 nt, Artificial Sequence; identical to SEQ ID NO: 47242
  neuraminidase__InfluenzaA__ADB89384

SEQ ID NO: 48479 - RNA, 1410 nt, Artificial Sequence; identical to SEQ ID NO: 47242
  neuraminidase__InfluenzaA__ADB89394

SEQ ID NO: 48480 - RNA, 1410 nt, Artificial Sequence
  neuraminidase__InfluenzaA__ADB89404
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaguauauugagaacacaagaaucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48481 - RNA, 1410 nt, Artificial Sequence; identical to SEQ ID NO: 47242
  neuraminidase__InfluenzaA__ADB89414

SEQ ID NO: 48482 - RNA, 1410 nt, Artificial Sequence; identical to SEQ ID NO: 47242
  neuraminidase__InfluenzaA__ADB89424

SEQ ID NO: 48483 - RNA, 1410 nt, Artificial Sequence; identical to SEQ ID NO: 47306
  neuraminidase__InfluenzaA__ADB89434

SEQ ID NO: 48484 - RNA, 1410 nt, Artificial Sequence; identical to SEQ ID NO: 47306
  neuraminidase__InfluenzaA__ADB89444

SEQ ID NO: 48485 - RNA, 1410 nt, Artificial Sequence
  neuraminidase__InfluenzaA__ADB89454
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugcuaaaguacaacggcauaauaacagacacuaucaagaguuggagaaacaauauauugagaacacaagagucugaaugugcauguguaaaugguucuugcuuuacuguaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcggaagcagcauauccuuuugugguguaaacagugacacuguggguuggucuuggccagacggugcugaguugccauuuaccauugacaaguaa

SEQ ID NO: 48486 - RNA, 1410 nt, Artificial Sequence; identical to SEQ ID NO: 47242
  neuraminidase__InfluenzaA__ADB89464

SEQ ID NO: 48487 - RNA, 1410 nt, Artificial Sequence; identical to SEQ ID NO: 47306
  neuraminidase__InfluenzaA__ADB89484

SEQ ID NO: 48488 - RNA, 1410 nt, Artificial Sequence
  neuraminidase__InfluenzaA__ADB89494
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacgggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48489 - RNA, 1410 nt, Artificial Sequence
  neuraminidase__InfluenzaA__ADB89504
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuuaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccaucgacaaguaa

SEQ ID NO: 48490 - RNA, 1410 nt, Artificial Sequence; identical to SEQ ID NO: 47242
  neuraminidase__InfluenzaA__ADB89514

SEQ ID NO: 48491 - RNA, 1410 nt, Artificial Sequence
  neuraminidase__InfluenzaA__ADB89524
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauucaccauugacaaguaa

SEQ ID NO: 48492 - RNA, 1410 nt, Artificial Sequence
  neuraminidase__InfluenzaA__ADB89544
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccucuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48493 - RNA, 1410 nt, Artificial Sequence; identical to SEQ ID NO: 47242
  neuraminidase__InfluenzaA__ADB89564

SEQ ID NO: 48494 - RNA, 1410 nt, Artificial Sequence; identical to SEQ ID NO: 47242
  neuraminidase__InfluenzaA__ADB89574

SEQ ID NO: 48495 - RNA, 1410 nt, Artificial Sequence; identical to SEQ ID NO: 47306
  neuraminidase__InfluenzaA__ADB89594

SEQ ID NO: 48496 - RNA, 1410 nt, Artificial Sequence; identical to SEQ ID NO: 48286
  neuraminidase__InfluenzaA__ADB89604

SEQ ID NO: 48497 - RNA, 1410 nt, Artificial Sequence
  neuraminidase__InfluenzaA__ADB89614
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcagcugugguccaguaucgucuaauggagcaaauggaguaaaaggauuuucauucaaauacggcaaugguauuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48498 - RNA, 1410 nt, Artificial Sequence; identical to SEQ ID NO: 48286
  neuraminidase__InfluenzaA__ADB89624

SEQ ID NO: 48499 - RNA, 1410 nt, Artificial Sequence; identical to SEQ ID NO: 47242
  neuraminidase__InfluenzaA__ADB89634

SEQ ID NO: 48500 - RNA, 1410 nt, Artificial Sequence; identical to SEQ ID NO: 48286
  neuraminidase__InfluenzaA__ADB89644

SEQ ID NO: 48501 - RNA, 1410 nt, Artificial Sequence
  neuraminidase__InfluenzaA__ADB89664
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcugaauuguauaagacccugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48502 - RNA, 1410 nt, Artificial Sequence
  neuraminidase__InfluenzaA__ADB89674
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaggggaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48503 - RNA, 1410 nt, Artificial Sequence
  neuraminidase__InfluenzaA__ADB89684
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48504 - RNA, 1410 nt, Artificial Sequence
  neuraminidase__InfluenzaA__ADB89694
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucacaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48505 - RNA, 1410 nt, Artificial Sequence
  neuraminidase__InfluenzaA__ADB89704
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48506 - RNA, 1410 nt, Artificial Sequence; identical to SEQ ID NO: 48505
  neuraminidase__InfluenzaA__ADB89714

SEQ ID NO: 48507 - RNA, 1410 nt, Artificial Sequence; identical to SEQ ID NO: 47962
  neuraminidase__InfluenzaA__ADB89724

SEQ ID NO: 48508 - RNA, 1410 nt, Artificial Sequence; identical to SEQ ID NO: 48087
  neuraminidase__InfluenzaA__ADB89735

SEQ ID NO: 48509 - RNA, 1410 nt, Artificial Sequence; identical to SEQ ID NO: 47242
  neuraminidase__InfluenzaA__ADB90357

SEQ ID NO: 48510 - RNA, 1410 nt, Artificial Sequence
  neuraminidase__InfluenzaA__ADB90358
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcauggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48511 - RNA, 1410 nt, Artificial Sequence
  neuraminidase__InfluenzaA__ADB90359
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaacuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugggccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48512 - RNA, 1410 nt, Artificial Sequence; identical to SEQ ID NO: 47439
  neuraminidase__InfluenzaA__ADB90363

SEQ ID NO: 48513 - RNA, 1410 nt, Artificial Sequence; identical to SEQ ID NO: 48419
  neuraminidase__InfluenzaA__ADB90373

SEQ ID NO: 48514 - RNA, 1410 nt, Artificial Sequence
  neuraminidase__InfluenzaA__ADB98137
augaauccaaaccaaaagauaauaaccauugguucggucuguaugacgauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48515 - RNA, 1410 nt, Artificial Sequence
  neuraminidase__InfluenzaA__ADB98138
augaauccaaaccaaaagauaauaaccauugguucggucuguaugacgauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48516 - RNA, 1410 nt, Artificial Sequence; identical to SEQ ID NO: 48286
  neuraminidase__InfluenzaA__ADB98139

SEQ ID NO: 48517 - RNA, 1410 nt, Artificial Sequence
  neuraminidase__InfluenzaA__ADB98140
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48518 - RNA, 1410 nt, Artificial Sequence; identical to SEQ ID NO: 48517
  neuraminidase__InfluenzaA__ADB98141

SEQ ID NO: 48519 - RNA, 1410 nt, Artificial Sequence
  neuraminidase__InfluenzaA__ADC32391
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48520 - RNA, 1410 nt, Artificial Sequence; identical to SEQ ID NO: 47707
  neuraminidase__InfluenzaA__ADC32392

SEQ ID NO: 48521 - RNA, 1410 nt, Artificial Sequence; identical to SEQ ID NO: 47306
  neuraminidase__InfluenzaA__ADC32393

SEQ ID NO: 48522 - RNA, 1410 nt, Artificial Sequence; identical to SEQ ID NO: 47306
  neuraminidase__InfluenzaA__ADC32394

SEQ ID NO: 48523 - RNA, 1410 nt, Artificial Sequence; identical to SEQ ID NO: 47306
  neuraminidase__InfluenzaA__ADC32395

SEQ ID NO: 48524 - RNA, 1410 nt, Artificial Sequence; identical to SEQ ID NO: 47306
  neuraminidase__InfluenzaA__ADC32396

SEQ ID NO: 48525 - RNA, 1410 nt, Artificial Sequence; identical to SEQ ID NO: 47306
  neuraminidase__InfluenzaA__ADC32397

SEQ ID NO: 48526 - RNA, 1410 nt, Artificial Sequence; identical to SEQ ID NO: 47306
  neuraminidase__InfluenzaA__ADC32398

SEQ ID NO: 48527 - RNA, 1410 nt, Artificial Sequence
  neuraminidase__InfluenzaA__ADC32399
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuguaauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggccguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48528 - RNA, 1410 nt, Artificial Sequence; identical to SEQ ID NO: 47306
  neuraminidase__InfluenzaA__ADC32400

SEQ ID NO: 48529 - RNA, 1410 nt, Artificial Sequence
  neuraminidase__InfluenzaA__ADC32401
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggaccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48530 - RNA, 1410 nt, Artificial Sequence
  neuraminidase__InfluenzaA__ADC32404
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48531 - RNA, 1410 nt, Artificial Sequence
  neuraminidase__InfluenzaA__ADC32407
augaauccaaagcaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucauuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugaucugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48532 - RNA, 1410 nt, Artificial Sequence
  neuraminidase__InfluenzaA__ADC34942
augaauccaaaucaaaagauaauaacgauuggcucuguuucucucaccauuuccacaauaugcuucuucaugcaaauugccaucuuaauaacuacuguaacauugcauuucaagcaauaugaauucaacccccccccaaacaaccaagugaugcugugugaaccaacaauaauagaaaggaacauaacagagauaguguaucugaccaacaccaccauagagaaggaaauaugccccaaacuagcagaauacagagaguggucaaagccgcaauguaauauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacgugcauucaaaugacauaguacgugauaggaccccuuaucggacccuauugaugaaugaguuagguguuccauuucaucuggggaccaagcaagugugcauagcaugguccagcucaaguugucacgauggaaaagcauggcugcauguuuguguaacgggggaugauaaaaaugcaacugcuagcuucauuuacaaugggaggcuuguagauaguauuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggagaggcuccaauaggcccauaguagauauaaacaugaaggauuauagcauuguuuccaguuaugugugcucaggacuuguuggagacacacccagaaaaaacgacagcuccagcaguggccauugcuugaauccuaacaaugaagaagguggucauggagugaaaggcugggccuuugaugauggaaaugacguguggaugggaagaacgaucagcgagaaguuacgcucaggauaugaaaccuucaaagucauugaaggcugguccaacccuaauuccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 48533 - RNA, 1410 nt, Artificial Sequence
  neuraminidase__InfluenzaA__ADC39000
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacaauguggguuggucuuggccagacggugcugaguugccauuuaccauugacaaguaa

SEQ ID NO: 48534 - RNA, 1410 nt, Artificial Sequence; identical to SEQ ID NO: 47439
  neuraminidase__InfluenzaA__ADC39010

SEQ ID NO: 48535 - RNA, 1413 nt, Artificial Sequence
  neuraminidase__InfluenzaA__ADC45606
augaauccaaaucaaaagauaauaaccauuggaucaaucaguauagcaaucggaauaauuagucuaauguugcaaauaggaaauauuauuucaauaugggcuagucacucaauccaaacuggaagucaaaacaauacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauugaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaauuggaauuucugguccagacaauggagcuguggcuguacuaaaauacaacggaauaauaacuggaaccauaaaaaguuggaaaaagcaaauauuaagaacacaagagucugaaugugucuguaugaacgggucauguuuuaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugaucugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48536 - RNA, 1413 nt, Artificial Sequence
  neuraminidase__InfluenzaA__ADC45628
augaauccaaaucaaaaaauaauaaccauuggaucaaucaguauagcaaucggaauaauuagucuaauguugcaaaugggaaauauuauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugaaaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 48537 - RNA, 1413 nt, Artificial Sequence
  neuraminidase__InfluenzaA__ADC45639
augaauccaaaucaaaaaauaauaaccauuggaucaaucaguauagcaaucggaauaauuagucuaauguugcaaauaggaaauauuauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaguuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 48538 - RNA, 1413 nt, Artificial Sequence
  neuraminidase__InfluenzaA__ADC45650
augaauccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48539 - RNA, 1413 nt, Artificial Sequence
  neuraminidase__InfluenzaA__ADC45661
augaauccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauacuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48540 - RNA, 1413 nt, Artificial Sequence
  neuraminidase__InfluenzaA__ADC45683
augaauccaaaucaaaaaauaauaaccauuggaucaaucaguauagcaaucggaauaauuagucuaauguugcaaauaggaaauauuauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggagaggacaaaacuccagugacauuggucggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuuggguguccuuuaaucaaaacuuggauuaucaaauaggauacaucugcaguggaguguucggugacaauccgcgucccaaagauagagagggcagcugcaauccagugacuguugauggagcaaacggaguaaaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauuggucuuggccagacggugcugaguugccguucaccauugacaaguag

SEQ ID NO: 48541 - RNA, 1413 nt, Artificial Sequence
  neuraminidase__InfluenzaA__ADC45705
augaauccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggcuggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaagaacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugacugauggcccgaguaauaaggccgccucguacaaaauuuucaagaucgaaaaggggaagguuacuaaaucaauagaguugaaugcacccaauuuucauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguucggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48542 - RNA, 1413 nt, Artificial Sequence
  neuraminidase__InfluenzaA__ADC45716
augaauccaaaucaaaaaauaauaaccauuggaucaaucaguauagcaaucggaauaauuagucuaauguugcaaauaggaaauauuauuucaauaugggcuagucacucaauucaaacuggaagucaaaaccacacuggaauaugcaaccaaagaaucaucacauaugaaaacagcaccugggugaaucacacauauguuaauauuaacaacacuaauguuguugcuggaaaggacaaaacuccagugacauuggucggcaacucaucucuuuguucuaucaguggaugggcuauauacacaaaagacaacagcauaagaauuggcuccaaaggagauguuuuugucauaagagaaccuuucauaucauguucucacuuggaaugcaaaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcauaggcugguuaacaaucggaauuucugguccagacaauggagcuguggcuguacuaaaauacaaaggaauaauaacuggaaccauaaaaaguuggaaaaagcaaauauuaagaacacaagagucugaaugugucuguaugaacgggucauguuucaccauaaugaccgaugguccgaguaauggggccgccucguacaaaauuuucaagaucgaaaaggggaagguuacuaaaucaauggaguugaaugcacccaauuuucauuaugaggaauguucuuguuacccagacacuggcacagugauguguguaugcagggacaacuggcaugguucaaaucgaccuugggugucuuuuaaucaaaacuuggauuaucaaauaggauacaucugcaguggaguguucggugacaauccgcgucccaaagauagagagggcagcugcaauccagugacuguugauggagcaaacggaguagaaggguuuucauacaaauaugguaaugguguuuggauaggaaggaccaaaaguaacagaauuagaaagggguuugagaugauuugggauccuaauggauggacaaauaccgacagugauuucucagugaaacaggauauuguagcaauaacuaauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauggugauauugcaaauugguccuggccagacggugcugaguugccguucaccauugacaaguag

SEQ ID NO: 48543 - RNA, 1413 nt, Artificial Sequence
  neuraminidase__InfluenzaA__ADC45738
augaauccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauacuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaauguuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugauaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugacacugcaaacuggucuuggccagacggugcugaguugccguucaccauugacaaguag

SEQ ID NO: 48544 - RNA, 1413 nt, Artificial Sequence
  neuraminidase__InfluenzaA__ADC45760
augaauccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccgcaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauugggcuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48545 - RNA, 1413 nt, Artificial Sequence
  neuraminidase__InfluenzaA__ADC45771
augaauccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucaaugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48546 - RNA, 1413 nt, Artificial Sequence
  neuraminidase__InfluenzaA__ADC45782
augaauccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaauaggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucugugugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48547 - RNA, 1413 nt, Artificial Sequence
  neuraminidase__InfluenzaA__ADC45804
augaauccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagauuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48548 - RNA, 1413 nt, Artificial Sequence
  neuraminidase__InfluenzaA__ADC45815
augaauccaaaucaaaagauaauaaccauaggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucuggcccagacaauggagcuguggcuguacuaaaauacaacggaauaauaacuggaaccguaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccggacacuggcauggugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48549 - RNA, 1413 nt, Artificial Sequence
  neuraminidase__InfluenzaA__ADC45837
augaauccaaaucaaaagauaauaaccauuggaucaaucaguauagcaaucggaauaauuagucuaauguugcaaauaggaaauauuauuucaauaugggcuagucacucaauccaaacugggagucaaaacaacacuggaauaugcaaccaaagaaucaucacauaugaaaacagcaccugggugaaucacacauauguuaauauuaacaacacuaauguuguugcuggagaggacaaaacaucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagauacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauagggaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48550 - RNA, 1413 nt, Artificial Sequence
  neuraminidase__InfluenzaA__ADC45848
augaauccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacuucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuuccuuuuguggcguuaauagugauacugcaaacuggucuuggccagacggugcugaguugccguucaccauugacaaguag

SEQ ID NO: 48551 - RNA, 1410 nt, Artificial Sequence; identical to SEQ ID NO: 47286
  neuraminidase__InfluenzaA__ADC53559

SEQ ID NO: 48552 - RNA, 1410 nt, Artificial Sequence; identical to SEQ ID NO: 47242
  neuraminidase__InfluenzaA__ADD14088

SEQ ID NO: 48553 - RNA, 1410 nt, Artificial Sequence; identical to SEQ ID NO: 47242
  neuraminidase__InfluenzaA__ADD14090

SEQ ID NO: 48554 - RNA, 1410 nt, Artificial Sequence; identical to SEQ ID NO: 47242
  neuraminidase__InfluenzaA__ADD14094

SEQ ID NO: 48555 - RNA, 1410 nt, Artificial Sequence; identical to SEQ ID NO: 47242
  neuraminidase__InfluenzaA__ADD14096

SEQ ID NO: 48556 - RNA, 1410 nt, Artificial Sequence; identical to SEQ ID NO: 47242
  neuraminidase__InfluenzaA__ADD14098

SEQ ID NO: 48557 - RNA, 1410 nt, Artificial Sequence; identical to SEQ ID NO: 47242
  neuraminidase__InfluenzaA__ADD14100

SEQ ID NO: 48558 - RNA, 1410 nt, Artificial Sequence; identical to SEQ ID NO: 47242
  neuraminidase__InfluenzaA__ADD14102

SEQ ID NO: 48559 - RNA, 1410 nt, Artificial Sequence; identical to SEQ ID NO: 47242
  neuraminidase__InfluenzaA__ADD14104

SEQ ID NO: 48560 - RNA, 1410 nt, Artificial Sequence; identical to SEQ ID NO: 47242
  neuraminidase__InfluenzaA__ADD14106

SEQ ID NO: 48561 - RNA, 1410 nt, Artificial Sequence; identical to SEQ ID NO: 47242
  neuraminidase__InfluenzaA__ADD14110

SEQ ID NO: 48562 - RNA, 1410 nt, Artificial Sequence
  neuraminidase__InfluenzaA__ADD14112
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggaguccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48563 - RNA, 1410 nt, Artificial Sequence
  neuraminidase__InfluenzaA__ADD14114
augaauccaaaccaaaagauaauaaccauugguucggucuguaugacaauuggaauggcuaacuuaauauuacaaauuggaaacauaaucucaauauggauuagccacucaauucaacuuggggaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48564 - RNA, 1410 nt, Artificial Sequence; identical to SEQ ID NO: 47242
  neuraminidase__InfluenzaA__ADD14116

SEQ ID NO: 48565 - RNA, 1410 nt, Artificial Sequence; identical to SEQ ID NO: 47242
  neuraminidase__InfluenzaA__ADD14118

SEQ ID NO: 48566 - RNA, 1410 nt, Artificial Sequence; identical to SEQ ID NO: 47242
  neuraminidase__InfluenzaA__ADD14120

SEQ ID NO: 48567 - RNA, 1410 nt, Artificial Sequence
  neuraminidase__InfluenzaA__ADD14122
augaauccaaaccaaaagauaauaaccauugguucggucuguaugaccauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48568 - RNA, 1410 nt, Artificial Sequence; identical to SEQ ID NO: 47242
  neuraminidase__InfluenzaA__ADD14124

SEQ ID NO: 48569 - RNA, 1410 nt, Artificial Sequence; identical to SEQ ID NO: 48301
  neuraminidase__InfluenzaA__ADD14126

SEQ ID NO: 48570 - RNA, 1410 nt, Artificial Sequence; identical to SEQ ID NO: 47242
  neuraminidase__InfluenzaA__ADD14128

SEQ ID NO: 48571 - RNA, 1410 nt, Artificial Sequence; identical to SEQ ID NO: 47242
  neuraminidase__InfluenzaA__ADD14130

SEQ ID NO: 48572 - RNA, 1410 nt, Artificial Sequence
  neuraminidase__InfluenzaA__ADD14132
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48573 - RNA, 1410 nt, Artificial Sequence; identical to SEQ ID NO: 47242
  neuraminidase__InfluenzaA__ADD14134

SEQ ID NO: 48574 - RNA, 1410 nt, Artificial Sequence; identical to SEQ ID NO: 47242
  neuraminidase__InfluenzaA__ADD14136

SEQ ID NO: 48575 - RNA, 1410 nt, Artificial Sequence; identical to SEQ ID NO: 47242
  neuraminidase__InfluenzaA__ADD14138

SEQ ID NO: 48576 - RNA, 1410 nt, Artificial Sequence
  neuraminidase__InfluenzaA__ADD14142
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacggacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48577 - RNA, 1410 nt, Artificial Sequence; identical to SEQ ID NO: 47242
  neuraminidase__InfluenzaA__ADD14144

SEQ ID NO: 48578 - RNA, 1410 nt, Artificial Sequence; identical to SEQ ID NO: 47242
  neuraminidase__InfluenzaA__ADD14146

SEQ ID NO: 48579 - RNA, 1410 nt, Artificial Sequence; identical to SEQ ID NO: 47242
  neuraminidase__InfluenzaA__ADD14148

SEQ ID NO: 48580 - RNA, 1410 nt, Artificial Sequence
  neuraminidase__InfluenzaA__ADD14150
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucgugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuauuaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagacgauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48581 - RNA, 1410 nt, Artificial Sequence
  neuraminidase__InfluenzaA__ADD14152
augaauccaaaccaaaagauaauaaccauugguucggucuguaugacaauuggaauggcuaacuuaauauuacaaauuggaaauauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48582 - RNA, 1410 nt, Artificial Sequence
  neuraminidase__InfluenzaA__ADD14154
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaucaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48583 - RNA, 1410 nt, Artificial Sequence; identical to SEQ ID NO: 47242
  neuraminidase__InfluenzaA__ADD14156

SEQ ID NO: 48584 - RNA, 1410 nt, Artificial Sequence; identical to SEQ ID NO: 47242
  neuraminidase__InfluenzaA__ADD14158

SEQ ID NO: 48585 - RNA, 1410 nt, Artificial Sequence; identical to SEQ ID NO: 47242
  neuraminidase__InfluenzaA__ADD14164

SEQ ID NO: 48586 - RNA, 1410 nt, Artificial Sequence; identical to SEQ ID NO: 47242
  neuraminidase__InfluenzaA__ADD14174

SEQ ID NO: 48587 - RNA, 1410 nt, Artificial Sequence; identical to SEQ ID NO: 47242
  neuraminidase__InfluenzaA__ADD14184

SEQ ID NO: 48588 - RNA, 1410 nt, Artificial Sequence; identical to SEQ ID NO: 47242
  neuraminidase__InfluenzaA__ADD14194

SEQ ID NO: 48589 - RNA, 1410 nt, Artificial Sequence; identical to SEQ ID NO: 47649
  neuraminidase__InfluenzaA__ADD14204

SEQ ID NO: 48590 - RNA, 1410 nt, Artificial Sequence
  neuraminidase__InfluenzaA__ADD21449
augaauccaaaccaaagaauaauaacuaucgggacagccugccugauaauuggaauaguuagucuauugcugcagauaggaaauauagucucauuauggauaagccauucgauucagacuggagaaaaaaaucacucugagacaugcaaccgaaauaccauuacauaugaaaacagcacaugggugaaccaaacuuauguaaacauuagcaauaucaacauugcugguggacagggcguggcuucaauaauacuugcuggcaauuccucucuuugcccaguaaaugggugggcuauauacaguaaagacaacagcauaaggauugguuccaaaggagacauuuuugucauaagagaaccauucaucucaugcucucacuuggagugcagaaccuuuuuucugacccaaggugccuuguuaaaugacaggcauucuaauggaacugucaaggacaggagccccuaccgaaccuuaaugagcugcccgauuggugaagcuccaucuccguauaauucaaaauucgaaucaguugcuuggucagcaagugcaugccaugaugggaugggauggcuaacaauugggauuuccgguccagauaauggagcaguggcuguuuugaaauacaaugguauaauaacagauacgauaaaaaguuggagaaacagaauacuaagaacacaagagucagaauguguuuguauaaacgguucauguuuuaccauaaugacugauggcccaagcaaugggcaagccuccuacaaaauauucaaaauggagagagggaagauuauuaagucaguugaacuggaugcaccuaauuaccacuaugaggaaugcuccuguuauccugauacaggcaaaguggugugugugugcagagacaacuggcaugcuucaaaucgaccguggguuuccuucgaucagaaucuugauuaucaaauaggguacauaagcagugggguuuuuggugauaacccgcguucuaaugaugggaagggcaauuguggcccaguacuuucuaauggagcaaauggagugaaaggauugucauuuagauauggcaauggugucuggauaggaagaacuaaaaguaccaacucuagaaguggauuugagaugauuugggauccaaauggauggacggaaacugauaguaauuuuucuaugaagcaagauauuauagcauuaacugauuggucaggauauaguggaaguuuuguucaacacccugaguuaacaggaaugaauugcauaaggccuuguuuuuggguagaauugaucagaggucaacccaagcaaagcacaaucuggacuaguggaagcagcauuucuuucuguggcguggacagugaaaccgcaagcuggucauggccagacggagcugaucugccauucaccauugacaaguag

SEQ ID NO: 48591 - RNA, 1413 nt, Artificial Sequence
  neuraminidase__InfluenzaA__ADD21469
augaauccaaaucaaaaaauaauaaccauuggaucaaucaguauagcaaucggaauaauuagucuaauguugcaaauaggaaauauuauuucaguaugggcuagucacucaauccaaacuggaagucaaaaccacacuggaauaugcaaccaaagaaucaucacauaugaaaacagcaccugggugaaucacacauauguuaauauuaacaacacuaauguuguugcuggaaaggacaaaacuucagugacauuggccggcaauucaucucuuuguucuaucaguggaugggcuauauacacaaaagacaacagcauaagaauuggauccaaaggagauguuuuugucauaagagaaccuuucauaucauguucucacuuggaaugcagaaccuuuuuucugacccaaggugcucuauuaaaugacaaacauucaaauggaaccguuaaggacagaaguccuuauagggccuuaaugagcugcccucuaggugaagcuccguccccauacaauucaaaguuugaaucaguugcauggucagcaagcgcaugccaugauggcaugggcugguuaacgaucggaauuucugguccagacaauggagcuguggcuguacuaaaauacaacggcauaauaacugaaaccauaaaaaguuggaaaaaacgaauguuaagaacacaagagucugaauguaucugugugaacgggucauguuucaccauaaugaccgauggcccgaguaauggggccgccucguacaaaaucuucaagaucgaaaaggggaagguuacuaaaucaauagaguugaaugcacccaauuuccauuaugaggaauguuccuguuacccagacacuggcacagugauguguguaugcagggacaacuggcaugguucaaaucgaccuugggugucuuuuaaucaaaaccuggauuaucaaauaggauacaucugcagugggguguucggugacaauccgcgucccaaagauggagagggcagcuguaauccagugacuguugauggagcagacggaguaaagggguuuucauacaaauaugguaaugguguuuggauaggaagaacuaaaaguaacagacuuagaaagggguuugagaugauuugggauccuaauggauggacagauaccgacaguaauuucucagugaaacaggauguuguggcaauaacugauuggucaggguacagcggaaguuucguucaacauccugaguuaacaggauuggacuguauaagaccuugcuucuggguugaguuagucagaggacugccuagagaaaauacaacaaucuggacuagugggagcagcauuucuuuuuguggcguaaauagugauacugcaaacuggucuuggccagacggugcugaguugccauucaccauugacaaguag

SEQ ID NO: 48592 - RNA, 1410 nt, Artificial Sequence; identical to SEQ ID NO: 48225
  neuraminidase__InfluenzaA__ADD21747

SEQ ID NO: 48593 - RNA, 1410 nt, Artificial Sequence
  neuraminidase__InfluenzaA__ADD21767
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48594 - RNA, 1410 nt, Artificial Sequence
  neuraminidase__InfluenzaA__ADD21777
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucagagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcugugauaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48595 - RNA, 1410 nt, Artificial Sequence; identical to SEQ ID NO: 48286
  neuraminidase__InfluenzaA__ADD21787

SEQ ID NO: 48596 - RNA, 1410 nt, Artificial Sequence
  neuraminidase__InfluenzaA__ADD21797
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48597 - RNA, 1410 nt, Artificial Sequence
  neuraminidase__InfluenzaA__ADD21817
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48598 - RNA, 1410 nt, Artificial Sequence; identical to SEQ ID NO: 48596
  neuraminidase__InfluenzaA__ADD21827

SEQ ID NO: 48599 - RNA, 1410 nt, Artificial Sequence
  neuraminidase__InfluenzaA__ADD21837
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugggucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggaucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48600 - RNA, 1410 nt, Artificial Sequence; identical to SEQ ID NO: 48286
  neuraminidase__InfluenzaA__ADD21847

SEQ ID NO: 48601 - RNA, 1410 nt, Artificial Sequence; identical to SEQ ID NO: 48286
  neuraminidase__InfluenzaA__ADD21857

SEQ ID NO: 48602 - RNA, 1410 nt, Artificial Sequence
  neuraminidase__InfluenzaA__ADD21867
augaauccaaaccaaaagauaauaaccauugguucggucuguaugacaauuggaauggcuaauuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugaguuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48603 - RNA, 1410 nt, Artificial Sequence; identical to SEQ ID NO: 47973
  neuraminidase__InfluenzaA__ADD21877

SEQ ID NO: 48604 - RNA, 1410 nt, Artificial Sequence; identical to SEQ ID NO: 47973
  neuraminidase__InfluenzaA__ADD21897

SEQ ID NO: 48605 - RNA, 1410 nt, Artificial Sequence; identical to SEQ ID NO: 47242
  neuraminidase__InfluenzaA__ADD22494

SEQ ID NO: 48606 - RNA, 1410 nt, Artificial Sequence; identical to SEQ ID NO: 47242
  neuraminidase__InfluenzaA__ADD22504

SEQ ID NO: 48607 - RNA, 1410 nt, Artificial Sequence; identical to SEQ ID NO: 48505
  neuraminidase__InfluenzaA__ADD22514

SEQ ID NO: 48608 - RNA, 1410 nt, Artificial Sequence
  neuraminidase__InfluenzaA__ADD22524
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48609 - RNA, 1410 nt, Artificial Sequence
  neuraminidase__InfluenzaA__ADD22534
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaguccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48610 - RNA, 1410 nt, Artificial Sequence
  neuraminidase__InfluenzaA__ADD22544
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguugaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48611 - RNA, 1410 nt, Artificial Sequence; identical to SEQ ID NO: 47973
  neuraminidase__InfluenzaA__ADD22557

SEQ ID NO: 48612 - RNA, 1410 nt, Artificial Sequence; identical to SEQ ID NO: 47242
  neuraminidase__InfluenzaA__ADD22567

SEQ ID NO: 48613 - RNA, 1410 nt, Artificial Sequence; identical to SEQ ID NO: 48608
  neuraminidase__InfluenzaA__ADD22577

SEQ ID NO: 48614 - RNA, 1410 nt, Artificial Sequence
  neuraminidase__InfluenzaA__ADD22587
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48615 - RNA, 1410 nt, Artificial Sequence
  neuraminidase__InfluenzaA__ADD22597
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48616 - RNA, 1410 nt, Artificial Sequence; identical to SEQ ID NO: 48505
  neuraminidase__InfluenzaA__ADD22617

SEQ ID NO: 48617 - RNA, 1410 nt, Artificial Sequence
  neuraminidase__InfluenzaA__ADD22627
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48618 - RNA, 1410 nt, Artificial Sequence; identical to SEQ ID NO: 47242
  neuraminidase__InfluenzaA__ADD22637

SEQ ID NO: 48619 - RNA, 1410 nt, Artificial Sequence
  neuraminidase__InfluenzaA__ADD22648
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaaugggaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaagggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48620 - RNA, 1410 nt, Artificial Sequence; identical to SEQ ID NO: 48610
  neuraminidase__InfluenzaA__ADD22658

SEQ ID NO: 48621 - RNA, 1410 nt, Artificial Sequence; identical to SEQ ID NO: 48610
  neuraminidase__InfluenzaA__ADD22668

SEQ ID NO: 48622 - RNA, 1410 nt, Artificial Sequence
  neuraminidase__InfluenzaA__ADD22688
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48623 - RNA, 1410 nt, Artificial Sequence; identical to SEQ ID NO: 48505
  neuraminidase__InfluenzaA__ADD22698

SEQ ID NO: 48624 - RNA, 1410 nt, Artificial Sequence
  neuraminidase__InfluenzaA__ADD22725
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagaaaacacaaucuggacuagcgggagcagcauauccuuuugugguguaaacagugacacuguggguuggucuuggccagacggugcugaguugccauuuaccauugacaaguaa

SEQ ID NO: 48625 - RNA, 1410 nt, Artificial Sequence; identical to SEQ ID NO: 48608
  neuraminidase__InfluenzaA__ADD22735

SEQ ID NO: 48626 - RNA, 1410 nt, Artificial Sequence; identical to SEQ ID NO: 48505
  neuraminidase__InfluenzaA__ADD22745

SEQ ID NO: 48627 - RNA, 1410 nt, Artificial Sequence
  neuraminidase__InfluenzaA__ADD22755
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcacuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaguccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48628 - RNA, 1410 nt, Artificial Sequence
  neuraminidase__InfluenzaA__ADD22765
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugauuggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48629 - RNA, 1410 nt, Artificial Sequence
  neuraminidase__InfluenzaA__ADD22775
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48630 - RNA, 1410 nt, Artificial Sequence
  neuraminidase__InfluenzaA__ADD22785
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccuguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48631 - RNA, 1410 nt, Artificial Sequence
  neuraminidase__InfluenzaA__ADD22795
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugaguuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48632 - RNA, 1410 nt, Artificial Sequence
  neuraminidase__InfluenzaA__ADD22805
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuuuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48633 - RNA, 1410 nt, Artificial Sequence; identical to SEQ ID NO: 48505
  neuraminidase__InfluenzaA__ADD22815

SEQ ID NO: 48634 - RNA, 1410 nt, Artificial Sequence; identical to SEQ ID NO: 47242
  neuraminidase__InfluenzaA__ADD22825

SEQ ID NO: 48635 - RNA, 1410 nt, Artificial Sequence; identical to SEQ ID NO: 48505
  neuraminidase__InfluenzaA__ADD22835

SEQ ID NO: 48636 - RNA, 1410 nt, Artificial Sequence; identical to SEQ ID NO: 47973
  neuraminidase__InfluenzaA__ADD22845

SEQ ID NO: 48637 - RNA, 1410 nt, Artificial Sequence; identical to SEQ ID NO: 47242
  neuraminidase__InfluenzaA__ADD22855

SEQ ID NO: 48638 - RNA, 1410 nt, Artificial Sequence; identical to SEQ ID NO: 47242
  neuraminidase__InfluenzaA__ADD22924

SEQ ID NO: 48639 - RNA, 1410 nt, Artificial Sequence; identical to SEQ ID NO: 48505
  neuraminidase__InfluenzaA__ADD22934

SEQ ID NO: 48640 - RNA, 1410 nt, Artificial Sequence; identical to SEQ ID NO: 48505
  neuraminidase__InfluenzaA__ADD22944

SEQ ID NO: 48641 - RNA, 1410 nt, Artificial Sequence; identical to SEQ ID NO: 48505
  neuraminidase__InfluenzaA__ADD22954

SEQ ID NO: 48642 - RNA, 1410 nt, Artificial Sequence
  neuraminidase__InfluenzaA__ADD22974
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuuguuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48643 - RNA, 1410 nt, Artificial Sequence; identical to SEQ ID NO: 48505
  neuraminidase__InfluenzaA__ADD23075

SEQ ID NO: 48644 - RNA, 1410 nt, Artificial Sequence
  neuraminidase__InfluenzaA__ADD23085
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaacuauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48645 - RNA, 1410 nt, Artificial Sequence; identical to SEQ ID NO: 47242
  neuraminidase__InfluenzaA__ADD23095

SEQ ID NO: 48646 - RNA, 1410 nt, Artificial Sequence; identical to SEQ ID NO: 48505
  neuraminidase__InfluenzaA__ADD23105

SEQ ID NO: 48647 - RNA, 1410 nt, Artificial Sequence
  neuraminidase__InfluenzaA__ADD23115
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggaucuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48648 - RNA, 1410 nt, Artificial Sequence; identical to SEQ ID NO: 48647
  neuraminidase__InfluenzaA__ADD23125

SEQ ID NO: 48649 - RNA, 1410 nt, Artificial Sequence
  neuraminidase__InfluenzaA__ADD23135
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaacauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaccuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48650 - RNA, 1410 nt, Artificial Sequence; identical to SEQ ID NO: 48286
  neuraminidase__InfluenzaA__ADD23145

SEQ ID NO: 48651 - RNA, 1410 nt, Artificial Sequence
  neuraminidase__InfluenzaA__ADD23155
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48652 - RNA, 1410 nt, Artificial Sequence; identical to SEQ ID NO: 48286
  neuraminidase__InfluenzaA__ADD23165

SEQ ID NO: 48653 - RNA, 1410 nt, Artificial Sequence; identical to SEQ ID NO: 48286
  neuraminidase__InfluenzaA__ADD23175

SEQ ID NO: 48654 - RNA, 1410 nt, Artificial Sequence; identical to SEQ ID NO: 48286
  neuraminidase__InfluenzaA__ADD23185

SEQ ID NO: 48655 - RNA, 1410 nt, Artificial Sequence; identical to SEQ ID NO: 48286
  neuraminidase__InfluenzaA__ADD23195

SEQ ID NO: 48656 - RNA, 1410 nt, Artificial Sequence
  neuraminidase__InfluenzaA__ADD23223
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48657 - RNA, 1410 nt, Artificial Sequence
  neuraminidase__InfluenzaA__ADD23233
augaauccaaaccaaaagauaauaaccauugguucggucuguaugacaauuggaauggcuaacuuaauauuacaaauuggaaacauaaucucaauauggauuggccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucuguccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48658 - RNA, 1410 nt, Artificial Sequence
  neuraminidase__InfluenzaA__ADD23243
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 48659 - RNA, 1410 nt, Artificial Sequence
  neuraminidase__InfluenzaA__ADD23253
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuagaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48660 - RNA, 1410 nt, Artificial Sequence
  neuraminidase__InfluenzaA__ADD23273
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccgagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48661 - RNA, 1410 nt, Artificial Sequence
  neuraminidase__InfluenzaA__ADD23283
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgaccaaaagagaacacaaucuggacuagcgggagcagcauauccuuuugugguguaaacagugacacuguggguuggucuuggccagacggugcugaguugccauuuaccauugacaaguaa

SEQ ID NO: 48662 - RNA, 1410 nt, Artificial Sequence
  neuraminidase__InfluenzaA__ADD23293
augaauccaaaccaaaagauaauaaccauugguucggucuguaugacaauuggaauggcuaacuuaauacuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48663 - RNA, 1410 nt, Artificial Sequence
  neuraminidase__InfluenzaA__ADD23303
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 48664 - RNA, 1410 nt, Artificial Sequence; identical to SEQ ID NO: 47242
  neuraminidase__InfluenzaA__ADD23313

SEQ ID NO: 48665 - RNA, 1410 nt, Artificial Sequence
  neuraminidase__InfluenzaA__ADD23323
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguauugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 48666 - RNA, 1410 nt, Artificial Sequence; identical to SEQ ID NO: 47242
  neuraminidase__InfluenzaA__ADD23333

SEQ ID NO: 48667 - RNA, 1410 nt, Artificial Sequence
  neuraminidase__InfluenzaA__ADD23358
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgagaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48668 - RNA, 1410 nt, Artificial Sequence
  neuraminidase__InfluenzaA__ADD23368
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48669 - RNA, 1410 nt, Artificial Sequence; identical to SEQ ID NO: 47242
  neuraminidase__InfluenzaA__ADD23378

SEQ ID NO: 48670 - RNA, 1410 nt, Artificial Sequence; identical to SEQ ID NO: 48658
  neuraminidase__InfluenzaA__ADD23388

SEQ ID NO: 48671 - RNA, 1410 nt, Artificial Sequence
  neuraminidase__InfluenzaA__ADD23398
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48672 - RNA, 1410 nt, Artificial Sequence
  neuraminidase__InfluenzaA__ADD23408
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaggaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48673 - RNA, 1410 nt, Artificial Sequence
  neuraminidase__InfluenzaA__ADD23438
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuugggugaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggguuugagaugauuugggauccgaacggauggacugggacagacaauagcuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48674 - RNA, 1410 nt, Artificial Sequence
  neuraminidase__InfluenzaA__ADD23448
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48675 - RNA, 1410 nt, Artificial Sequence; identical to SEQ ID NO: 48286
  neuraminidase__InfluenzaA__ADD23458

SEQ ID NO: 48676 - RNA, 1410 nt, Artificial Sequence
  neuraminidase__InfluenzaA__ADD23468
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaguaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 48677 - RNA, 1410 nt, Artificial Sequence; identical to SEQ ID NO: 48658
  neuraminidase__InfluenzaA__ADD23478

SEQ ID NO: 48678 - RNA, 1410 nt, Artificial Sequence; identical to SEQ ID NO: 48286
  neuraminidase__InfluenzaA__ADD23488

SEQ ID NO: 48679 - RNA, 1410 nt, Artificial Sequence
  neuraminidase__InfluenzaA__ADD23498
augaauccaaaccaaaagauaauaaccauugguucggucuguaugacaauuggaauggcuaacuuaauauuacaaauuggaaacauaaucucaauauggauuagccacucaauucaacuugggaaucaaaaucauauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaacauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48680 - RNA, 1410 nt, Artificial Sequence; identical to SEQ ID NO: 47242
  neuraminidase__InfluenzaA__ADD23508

SEQ ID NO: 48681 - RNA, 1410 nt, Artificial Sequence
  neuraminidase__InfluenzaA__ADD23518
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaccacuaugaggaaugcuccuguuauccugauucuagugaaaucacaugugugugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 48682 - RNA, 1410 nt, Artificial Sequence; identical to SEQ ID NO: 48286
  neuraminidase__InfluenzaA__ADD23997

SEQ ID NO: 48683 - RNA, 1410 nt, Artificial Sequence
  neuraminidase__InfluenzaA__ADD24007
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48684 - RNA, 1410 nt, Artificial Sequence; identical to SEQ ID NO: 48617
  neuraminidase__InfluenzaA__ADD24017

SEQ ID NO: 48685 - RNA, 1410 nt, Artificial Sequence; identical to SEQ ID NO: 47242
  neuraminidase__InfluenzaA__ADD24024

SEQ ID NO: 48686 - RNA, 1410 nt, Artificial Sequence; identical to SEQ ID NO: 47689
  neuraminidase__InfluenzaA__ADD24025

SEQ ID NO: 48687 - RNA, 1410 nt, Artificial Sequence; identical to SEQ ID NO: 47379
  neuraminidase__InfluenzaA__ADD24026

SEQ ID NO: 48688 - RNA, 1410 nt, Artificial Sequence; identical to SEQ ID NO: 47242
  neuraminidase__InfluenzaA__ADD24027

SEQ ID NO: 48689 - RNA, 1410 nt, Artificial Sequence; identical to SEQ ID NO: 47242
  neuraminidase__InfluenzaA__ADD24028

SEQ ID NO: 48690 - RNA, 1410 nt, Artificial Sequence; identical to SEQ ID NO: 47242
  neuraminidase__InfluenzaA__ADD24029

SEQ ID NO: 48691 - RNA, 1410 nt, Artificial Sequence; identical to SEQ ID NO: 48431
  neuraminidase__InfluenzaA__ADD24030

SEQ ID NO: 48692 - RNA, 1410 nt, Artificial Sequence; identical to SEQ ID NO: 47242
  neuraminidase__InfluenzaA__ADD24031

SEQ ID NO: 48693 - RNA, 1410 nt, Artificial Sequence; identical to SEQ ID NO: 47242
  neuraminidase__InfluenzaA__ADD24032

SEQ ID NO: 48694 - RNA, 1410 nt, Artificial Sequence
  neuraminidase__InfluenzaA__ADD25231
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaagaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggaguagcauauccuuuugugguguaaacagugacacuguggguuggucuuggccagacggugcugaguugccauuuaccauugacaaguaa

SEQ ID NO: 48695 - RNA, 1410 nt, Artificial Sequence
  neuraminidase__InfluenzaA__ADD25233
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuuguuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48696 - RNA, 1410 nt, Artificial Sequence
  neuraminidase__InfluenzaA__ADD25235
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuuguuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48697 - RNA, 1410 nt, Artificial Sequence
  neuraminidase__InfluenzaA__ADD25244
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagugucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuuguuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48698 - RNA, 1410 nt, Artificial Sequence
  neuraminidase__InfluenzaA__ADD25246
augaauccaaaccaaaagauaauaaccauugguucagucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaccaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48699 - RNA, 1410 nt, Artificial Sequence
  neuraminidase__InfluenzaA__ADD25248
augaauccaaaccaaaagauaauaaccauugguucggucuguaugacaauuggaauggcuaaccuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauauauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48700 - RNA, 1410 nt, Artificial Sequence
  neuraminidase__InfluenzaA__ADD25250
augaauccaaaccaaaagauaauaaccauugguucggucuguaugacaauuggaauggcuaacuuaauauuacaaauuggaaacauaaucucaauauggauuagccgcucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuauggguuggucuuggccagacggugcugaguugccauuuaccauugacaaguaa

SEQ ID NO: 48701 - RNA, 1410 nt, Artificial Sequence; identical to SEQ ID NO: 48696
  neuraminidase__InfluenzaA__ADD25255

SEQ ID NO: 48702 - RNA, 1410 nt, Artificial Sequence
  neuraminidase__InfluenzaA__ADD25259
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48703 - RNA, 1410 nt, Artificial Sequence
  neuraminidase__InfluenzaA__ADD25262
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcagauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48704 - RNA, 1410 nt, Artificial Sequence
  neuraminidase__InfluenzaA__ADD25266
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48705 - RNA, 1410 nt, Artificial Sequence
  neuraminidase__InfluenzaA__ADD25268
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48706 - RNA, 1410 nt, Artificial Sequence
  neuraminidase__InfluenzaA__ADD25271
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48707 - RNA, 1410 nt, Artificial Sequence; identical to SEQ ID NO: 47439
  neuraminidase__InfluenzaA__ADD25274

SEQ ID NO: 48708 - RNA, 1410 nt, Artificial Sequence; identical to SEQ ID NO: 47439
  neuraminidase__InfluenzaA__ADD25276

SEQ ID NO: 48709 - RNA, 1410 nt, Artificial Sequence
  neuraminidase__InfluenzaA__ADD25278
augaauccaaaccaaaagauaauaaccauugguucggucuguaugacaauuggaauggcuaacuuaauauuacaaauuggaaacauaaucucaauauggauuagccgcucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48710 - RNA, 1410 nt, Artificial Sequence; identical to SEQ ID NO: 48319
  neuraminidase__InfluenzaA__ADD25280

SEQ ID NO: 48711 - RNA, 1410 nt, Artificial Sequence
  neuraminidase__InfluenzaA__ADD25282
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaguauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48712 - RNA, 1410 nt, Artificial Sequence; identical to SEQ ID NO: 48530
  neuraminidase__InfluenzaA__ADD25284

SEQ ID NO: 48713 - RNA, 1410 nt, Artificial Sequence
  neuraminidase__InfluenzaA__ADD25287
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaauacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48714 - RNA, 1410 nt, Artificial Sequence; identical to SEQ ID NO: 47306
  neuraminidase__InfluenzaA__ADD25291

SEQ ID NO: 48715 - RNA, 1410 nt, Artificial Sequence; identical to SEQ ID NO: 48530
  neuraminidase__InfluenzaA__ADD25293

SEQ ID NO: 48716 - RNA, 1410 nt, Artificial Sequence
  neuraminidase__InfluenzaA__ADD25300
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugugucaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48717 - RNA, 1410 nt, Artificial Sequence
  neuraminidase__InfluenzaA__ADD25304
augaauccaaaccaaaagauaauaaccauugguucggucuguaugacaauuggaauggcuaacuuaauauuacaaauuggaaacauagucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguagcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48718 - RNA, 1410 nt, Artificial Sequence
  neuraminidase__InfluenzaA__ADD25306
augaauccaaaccaaaagauaauaaccauugguucggucuguaugacaauuggaauggcuaacuuaauauuacaaauuggaaacauaaucucaauauggauuagccgcucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugauaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugaaccaagugauggacaggccucauacaagaucuucagaauagaaaagggaaagauagucaaaucagucgaaaugaaugccccuaauuaucacuaugaggaaugcuccuguuauccugauucuggugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48719 - RNA, 1410 nt, Artificial Sequence; identical to SEQ ID NO: 47306
  neuraminidase__InfluenzaA__ADD25308

SEQ ID NO: 48720 - RNA, 1410 nt, Artificial Sequence; identical to SEQ ID NO: 47306
  neuraminidase__InfluenzaA__ADD25310

SEQ ID NO: 48721 - RNA, 1410 nt, Artificial Sequence; identical to SEQ ID NO: 48706
  neuraminidase__InfluenzaA__ADD25312

SEQ ID NO: 48722 - RNA, 1410 nt, Artificial Sequence; identical to SEQ ID NO: 47242
  neuraminidase__InfluenzaA__ADD25314

SEQ ID NO: 48723 - RNA, 1410 nt, Artificial Sequence; identical to SEQ ID NO: 48706
  neuraminidase__InfluenzaA__ADD25316

SEQ ID NO: 48724 - RNA, 1410 nt, Artificial Sequence
  neuraminidase__InfluenzaA__ADD29799
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggugccuugcuaaaugacaaacauuccaauggaaccauuaaagacaggaguccauaucgaacccuaaugagcuguccuauuggugaaguucccucuccauacaacucaagguuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48725 - RNA, 1410 nt, Artificial Sequence
  neuraminidase__InfluenzaA__ADD29800
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguugaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48726 - RNA, 1410 nt, Artificial Sequence
  neuraminidase__InfluenzaA__ADD29801
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugcccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaaaggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48727 - RNA, 1410 nt, Artificial Sequence; identical to SEQ ID NO: 47242
  neuraminidase__InfluenzaA__ADD29802

SEQ ID NO: 48728 - RNA, 1410 nt, Artificial Sequence
  neuraminidase__InfluenzaA__ADD29803
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48729 - RNA, 1410 nt, Artificial Sequence
  neuraminidase__InfluenzaA__ADD29804
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguucuaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48730 - RNA, 1410 nt, Artificial Sequence
  neuraminidase__InfluenzaA__ADD29805
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuucugugguguaaacagugacacuguggguuggucuuggccagacggugcugaguugccauuuaccauugacaaguaa

SEQ ID NO: 48731 - RNA, 1410 nt, Artificial Sequence; identical to SEQ ID NO: 47242
  neuraminidase__InfluenzaA__ADD29806

SEQ ID NO: 48732 - RNA, 1410 nt, Artificial Sequence; identical to SEQ ID NO: 47242
  neuraminidase__InfluenzaA__ADD29807

SEQ ID NO: 48733 - RNA, 1410 nt, Artificial Sequence
  neuraminidase__InfluenzaA__ADD29808
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagguuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48734 - RNA, 1410 nt, Artificial Sequence; identical to SEQ ID NO: 47242
  neuraminidase__InfluenzaA__ADD52538

SEQ ID NO: 48735 - RNA, 1410 nt, Artificial Sequence; identical to SEQ ID NO: 48465
  neuraminidase__InfluenzaA__ADD74353

SEQ ID NO: 48736 - RNA, 1410 nt, Artificial Sequence
  neuraminidase__InfluenzaA__ADD74373
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcaauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48737 - RNA, 1410 nt, Artificial Sequence; identical to SEQ ID NO: 48225
  neuraminidase__InfluenzaA__ADD74383

SEQ ID NO: 48738 - RNA, 1410 nt, Artificial Sequence
  neuraminidase__InfluenzaA__ADD74401
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacauucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48739 - RNA, 1410 nt, Artificial Sequence
  neuraminidase__InfluenzaA__ADD74411
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacguugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccaucuccauacaacucaagauuugagucagucgcuuggucagcaagugcuugucaugauggcaucaauuggcuaacgauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcagugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48740 - RNA, 1410 nt, Artificial Sequence; identical to SEQ ID NO: 47242
  neuraminidase__InfluenzaA__ADD74421

SEQ ID NO: 48741 - RNA, 1410 nt, Artificial Sequence; identical to SEQ ID NO: 47242
  neuraminidase__InfluenzaA__ADD74431

SEQ ID NO: 48742 - RNA, 1410 nt, Artificial Sequence
  neuraminidase__InfluenzaA__ADD74441
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggccauauacagcaaagacaacagcauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguuccugcuuuacuguaaugaccgaugggccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaucuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48743 - RNA, 1410 nt, Artificial Sequence; identical to SEQ ID NO: 48738
  neuraminidase__InfluenzaA__ADD74451

SEQ ID NO: 48744 - RNA, 1410 nt, Artificial Sequence; identical to SEQ ID NO: 48225
  neuraminidase__InfluenzaA__ADD74461

SEQ ID NO: 48745 - RNA, 1410 nt, Artificial Sequence
  neuraminidase__InfluenzaA__ADD74471
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccguuuaccauugacaaguaa

SEQ ID NO: 48746 - RNA, 1410 nt, Artificial Sequence; identical to SEQ ID NO: 48286
  neuraminidase__InfluenzaA__ADD74481

SEQ ID NO: 48747 - RNA, 1410 nt, Artificial Sequence
  neuraminidase__InfluenzaA__ADD74491
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucauaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48748 - RNA, 1410 nt, Artificial Sequence; identical to SEQ ID NO: 48738
  neuraminidase__InfluenzaA__ADD74501

SEQ ID NO: 48749 - RNA, 1410 nt, Artificial Sequence; identical to SEQ ID NO: 47242
  neuraminidase__InfluenzaA__ADD74511

SEQ ID NO: 48750 - RNA, 1410 nt, Artificial Sequence
  neuraminidase__InfluenzaA__ADD74521
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48751 - RNA, 1410 nt, Artificial Sequence
  neuraminidase__InfluenzaA__ADD74531
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagacccugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48752 - RNA, 1410 nt, Artificial Sequence
  neuraminidase__InfluenzaA__ADD74551
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacuauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48753 - RNA, 1410 nt, Artificial Sequence; identical to SEQ ID NO: 47242
  neuraminidase__InfluenzaA__ADD74561

SEQ ID NO: 48754 - RNA, 1410 nt, Artificial Sequence; identical to SEQ ID NO: 47242
  neuraminidase__InfluenzaA__ADD74571

SEQ ID NO: 48755 - RNA, 1410 nt, Artificial Sequence
  neuraminidase__InfluenzaA__ADD74581
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacgcuguggguuggucuuggccagacggugcugaguugccauuuaccauugacaaguaa

SEQ ID NO: 48756 - RNA, 1410 nt, Artificial Sequence; identical to SEQ ID NO: 47242
  neuraminidase__InfluenzaA__ADD74591

SEQ ID NO: 48757 - RNA, 1410 nt, Artificial Sequence; identical to SEQ ID NO: 47242
  neuraminidase__InfluenzaA__ADD74601

SEQ ID NO: 48758 - RNA, 1410 nt, Artificial Sequence
  neuraminidase__InfluenzaA__ADD74611
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaauaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48759 - RNA, 1410 nt, Artificial Sequence; identical to SEQ ID NO: 48286
  neuraminidase__InfluenzaA__ADD74621

SEQ ID NO: 48760 - RNA, 1410 nt, Artificial Sequence; identical to SEQ ID NO: 47439
  neuraminidase__InfluenzaA__ADD74631

SEQ ID NO: 48761 - RNA, 1410 nt, Artificial Sequence; identical to SEQ ID NO: 47242
  neuraminidase__InfluenzaA__ADD74641

SEQ ID NO: 48762 - RNA, 1410 nt, Artificial Sequence
  neuraminidase__InfluenzaA__ADD74651
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucguggccagacggugcugaguugccauuuaccauugacaaguaa

SEQ ID NO: 48763 - RNA, 1410 nt, Artificial Sequence; identical to SEQ ID NO: 48668
  neuraminidase__InfluenzaA__ADD74661

SEQ ID NO: 48764 - RNA, 1410 nt, Artificial Sequence
  neuraminidase__InfluenzaA__ADD74671
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48765 - RNA, 1410 nt, Artificial Sequence; identical to SEQ ID NO: 47242
  neuraminidase__InfluenzaA__ADD74681

SEQ ID NO: 48766 - RNA, 1410 nt, Artificial Sequence
  neuraminidase__InfluenzaA__ADD74691
augaauccaaaccaaaagauaauaaccauugguucggucuguaugacaauuggaauggcuaacuuaauauuacaaauuggaaacauaaucucaauauggauuugccacucaauucaacuugggaaucaaaaucagaucgaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48767 - RNA, 1410 nt, Artificial Sequence
  neuraminidase__InfluenzaA__ADD74701
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccugucaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48768 - RNA, 1410 nt, Artificial Sequence; identical to SEQ ID NO: 47242
  neuraminidase__InfluenzaA__ADD74711

SEQ ID NO: 48769 - RNA, 1410 nt, Artificial Sequence
  neuraminidase__InfluenzaA__ADD74721
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48770 - RNA, 1410 nt, Artificial Sequence; identical to SEQ ID NO: 48286
  neuraminidase__InfluenzaA__ADD74731

SEQ ID NO: 48771 - RNA, 1410 nt, Artificial Sequence
  neuraminidase__InfluenzaA__ADD74741
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaguuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48772 - RNA, 1410 nt, Artificial Sequence
  neuraminidase__InfluenzaA__ADD74751
augaauccaaaccaaaagauaauaaccauugguucggucuguaugacaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucugaaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaaugaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48773 - RNA, 1410 nt, Artificial Sequence
  neuraminidase__InfluenzaA__ADD74761
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguauaaacagugacacuguggguuggucuuggccagacggugcugaguugccauuuaccauugacaaguaa

SEQ ID NO: 48774 - RNA, 1410 nt, Artificial Sequence
  neuraminidase__InfluenzaA__ADD74791
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaccgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48775 - RNA, 1410 nt, Artificial Sequence
  neuraminidase__InfluenzaA__ADD74811
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48776 - RNA, 1410 nt, Artificial Sequence
  neuraminidase__InfluenzaA__ADD74821
augaauccaaaccaaaagauaauaaccauugguucggucuguaugacaauuggaauggcuaacuuaauauuacaaauuggaaacauaaucucaauauggauuagccacucaauucaacuugggaaucaaaaccagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48777 - RNA, 1410 nt, Artificial Sequence
  neuraminidase__InfluenzaA__ADD74831
augaauccaaaccaaaagauaauaaccauugguucgaucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguuugaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48778 - RNA, 1410 nt, Artificial Sequence; identical to SEQ ID NO: 47242
  neuraminidase__InfluenzaA__ADD74841

SEQ ID NO: 48779 - RNA, 1410 nt, Artificial Sequence
  neuraminidase__InfluenzaA__ADD74851
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48780 - RNA, 1410 nt, Artificial Sequence
  neuraminidase__InfluenzaA__ADD74861
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48781 - RNA, 1410 nt, Artificial Sequence; identical to SEQ ID NO: 47242
  neuraminidase__InfluenzaA__ADD74871

SEQ ID NO: 48782 - RNA, 1410 nt, Artificial Sequence
  neuraminidase__InfluenzaA__ADD74881
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggcaucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48783 - RNA, 1410 nt, Artificial Sequence; identical to SEQ ID NO: 47242
  neuraminidase__InfluenzaA__ADD74891

SEQ ID NO: 48784 - RNA, 1410 nt, Artificial Sequence; identical to SEQ ID NO: 48769
  neuraminidase__InfluenzaA__ADD74901

SEQ ID NO: 48785 - RNA, 1410 nt, Artificial Sequence
  neuraminidase__InfluenzaA__ADD74911
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucgugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48786 - RNA, 1410 nt, Artificial Sequence; identical to SEQ ID NO: 48286
  neuraminidase__InfluenzaA__ADD74921

SEQ ID NO: 48787 - RNA, 1410 nt, Artificial Sequence
  neuraminidase__InfluenzaA__ADD74941
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaacuuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48788 - RNA, 1410 nt, Artificial Sequence
  neuraminidase__InfluenzaA__ADD74961
augaauccaaaccaaaagauaauaaccauugguucggucuguaugacaauuggaauggcuaacuuaauauuacaaauuggaaacauaaucucaauauggauuagccacucaauucaacuugggaaucaaaaucagauuggaacaugcaaucaaagcgucauuacuuaugaaaacaacacuuggguaaaucauacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48789 - RNA, 1410 nt, Artificial Sequence; identical to SEQ ID NO: 48286
  neuraminidase__InfluenzaA__ADD74971

SEQ ID NO: 48790 - RNA, 1410 nt, Artificial Sequence
  neuraminidase__InfluenzaA__ADD74981
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccgaagagaacacaaucuggacuagcgggagcagcauauccuuuugugguguaaacagugacacuguggguuggucuuggccagacggugcugaguugccauuuaccauugacaaguaa

SEQ ID NO: 48791 - RNA, 1410 nt, Artificial Sequence; identical to SEQ ID NO: 48286
  neuraminidase__InfluenzaA__ADD74991

SEQ ID NO: 48792 - RNA, 1410 nt, Artificial Sequence; identical to SEQ ID NO: 48286
  neuraminidase__InfluenzaA__ADD75001

SEQ ID NO: 48793 - RNA, 1410 nt, Artificial Sequence
  neuraminidase__InfluenzaA__ADD75011
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugauccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48794 - RNA, 1410 nt, Artificial Sequence; identical to SEQ ID NO: 48530
  neuraminidase__InfluenzaA__ADD75031

SEQ ID NO: 48795 - RNA, 1410 nt, Artificial Sequence
  neuraminidase__InfluenzaA__ADD75041
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaaaacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48796 - RNA, 1410 nt, Artificial Sequence
  neuraminidase__InfluenzaA__ADD75051
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48797 - RNA, 1410 nt, Artificial Sequence
  neuraminidase__InfluenzaA__ADD75061
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucuuugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48798 - RNA, 1410 nt, Artificial Sequence
  neuraminidase__InfluenzaA__ADD75071
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaguugaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48799 - RNA, 1410 nt, Artificial Sequence; identical to SEQ ID NO: 47439
  neuraminidase__InfluenzaA__ADD75081

SEQ ID NO: 48800 - RNA, 1410 nt, Artificial Sequence
  neuraminidase__InfluenzaA__ADD75091
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 48801 - RNA, 1410 nt, Artificial Sequence
  neuraminidase__InfluenzaA__ADD75101
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48802 - RNA, 1410 nt, Artificial Sequence
  neuraminidase__InfluenzaA__ADD75111
augaauccaaaccaaaagauaauaaccauugguucggucuguaugacaauuggaauggcuaacuuaauauuacaaauuggaaacauaaucucaauauggauuagccacucaauccaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48803 - RNA, 1410 nt, Artificial Sequence
  neuraminidase__InfluenzaA__ADD75121
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcggaaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48804 - RNA, 1410 nt, Artificial Sequence
  neuraminidase__InfluenzaA__ADD75131
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48805 - RNA, 1410 nt, Artificial Sequence; identical to SEQ ID NO: 47242
  neuraminidase__InfluenzaA__ADD75141

SEQ ID NO: 48806 - RNA, 1410 nt, Artificial Sequence
  neuraminidase__InfluenzaA__ADD75161
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcugaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauauaagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacagguaa

SEQ ID NO: 48807 - RNA, 1410 nt, Artificial Sequence
  neuraminidase__InfluenzaA__ADD84500
augaauccaaaccaaaauauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuauuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48808 - RNA, 1410 nt, Artificial Sequence
  neuraminidase__InfluenzaA__ADD84502
augaauccaaaccaaaauauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48809 - RNA, 1410 nt, Artificial Sequence; identical to SEQ ID NO: 48808
  neuraminidase__InfluenzaA__ADD84503

SEQ ID NO: 48810 - RNA, 1410 nt, Artificial Sequence
  neuraminidase__InfluenzaA__ADD84504
augaauccaaaccaaaauauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuucucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacguccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48811 - RNA, 1410 nt, Artificial Sequence; identical to SEQ ID NO: 48808
  neuraminidase__InfluenzaA__ADD84505

SEQ ID NO: 48812 - RNA, 1410 nt, Artificial Sequence; identical to SEQ ID NO: 48808
  neuraminidase__InfluenzaA__ADD84506

SEQ ID NO: 48813 - RNA, 1410 nt, Artificial Sequence
  neuraminidase__InfluenzaA__ADD92528
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaacuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggacauagcgggaguucuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48814 - RNA, 1410 nt, Artificial Sequence; identical to SEQ ID NO: 48465
  neuraminidase__InfluenzaA__ADD96769

SEQ ID NO: 48815 - RNA, 1410 nt, Artificial Sequence; identical to SEQ ID NO: 48465
  neuraminidase__InfluenzaA__ADD96779

SEQ ID NO: 48816 - RNA, 1410 nt, Artificial Sequence; identical to SEQ ID NO: 48465
  neuraminidase__InfluenzaA__ADD96789

SEQ ID NO: 48817 - RNA, 1410 nt, Artificial Sequence; identical to SEQ ID NO: 48593
  neuraminidase__InfluenzaA__ADD96799

SEQ ID NO: 48818 - RNA, 1410 nt, Artificial Sequence
  neuraminidase__InfluenzaA__ADD96809
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaaguauuaguucaagaaacgguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugagcuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48819 - RNA, 1410 nt, Artificial Sequence
  neuraminidase__InfluenzaA__ADD96819
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaguuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48820 - RNA, 1410 nt, Artificial Sequence
  neuraminidase__InfluenzaA__ADD96829
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggguuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48821 - RNA, 1410 nt, Artificial Sequence; identical to SEQ ID NO: 47242
  neuraminidase__InfluenzaA__ADD96839

SEQ ID NO: 48822 - RNA, 1410 nt, Artificial Sequence; identical to SEQ ID NO: 48738
  neuraminidase__InfluenzaA__ADD96849

SEQ ID NO: 48823 - RNA, 1410 nt, Artificial Sequence; identical to SEQ ID NO: 47242
  neuraminidase__InfluenzaA__ADD96859

SEQ ID NO: 48824 - RNA, 1410 nt, Artificial Sequence
  neuraminidase__InfluenzaA__ADD96869
augaauccaaaccaaaagauaauaaccauugguucggucuguaugacaauuggaauggcuaacuuaauauuacaaauuggaaacauaaucucaauauggauuagccacccaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuguaauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48825 - RNA, 1410 nt, Artificial Sequence
  neuraminidase__InfluenzaA__ADD96879
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuugggaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48826 - RNA, 1410 nt, Artificial Sequence
  neuraminidase__InfluenzaA__ADD96889
augaauccaaaccaaaagauaauaaccauugggucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaauaauauauugagaacacaagagucugaaugugcauguguaaaugguucuugcuuuacuguaaugaccgauggaccaagugauggacaggcaucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48827 - RNA, 1410 nt, Artificial Sequence
  neuraminidase__InfluenzaA__ADD96899
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48828 - RNA, 1410 nt, Artificial Sequence; identical to SEQ ID NO: 48286
  neuraminidase__InfluenzaA__ADD96909

SEQ ID NO: 48829 - RNA, 1410 nt, Artificial Sequence; identical to SEQ ID NO: 48286
  neuraminidase__InfluenzaA__ADD96919

SEQ ID NO: 48830 - RNA, 1410 nt, Artificial Sequence; identical to SEQ ID NO: 48286
  neuraminidase__InfluenzaA__ADD96929

SEQ ID NO: 48831 - RNA, 1410 nt, Artificial Sequence
  neuraminidase__InfluenzaA__ADD96939
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48832 - RNA, 1410 nt, Artificial Sequence; identical to SEQ ID NO: 48804
  neuraminidase__InfluenzaA__ADD96959

SEQ ID NO: 48833 - RNA, 1410 nt, Artificial Sequence
  neuraminidase__InfluenzaA__ADD96969
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48834 - RNA, 1410 nt, Artificial Sequence
  neuraminidase__InfluenzaA__ADD96989
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaauaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48835 - RNA, 1410 nt, Artificial Sequence
  neuraminidase__InfluenzaA__ADD97038
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaauacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggauugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuggggguuggucuuggccagacggugcugaguugccauuuaccauugacaaguaa

SEQ ID NO: 48836 - RNA, 1410 nt, Artificial Sequence
  neuraminidase__InfluenzaA__ADD97048
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaauucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48837 - RNA, 1410 nt, Artificial Sequence
  neuraminidase__InfluenzaA__ADD97058
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaaggaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48838 - RNA, 1410 nt, Artificial Sequence
  neuraminidase__InfluenzaA__ADD97069
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48839 - RNA, 1410 nt, Artificial Sequence; identical to SEQ ID NO: 48837
  neuraminidase__InfluenzaA__ADD97126

SEQ ID NO: 48840 - RNA, 1410 nt, Artificial Sequence; identical to SEQ ID NO: 47686
  neuraminidase__InfluenzaA__ADD97164

SEQ ID NO: 48841 - RNA, 1410 nt, Artificial Sequence; identical to SEQ ID NO: 48833
  neuraminidase__InfluenzaA__ADD97174

SEQ ID NO: 48842 - RNA, 1410 nt, Artificial Sequence; identical to SEQ ID NO: 47242
  neuraminidase__InfluenzaA__ADD97184

SEQ ID NO: 48843 - RNA, 1410 nt, Artificial Sequence
  neuraminidase__InfluenzaA__ADD97194
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacgccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48844 - RNA, 1410 nt, Artificial Sequence
  neuraminidase__InfluenzaA__ADD97204
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48845 - RNA, 1410 nt, Artificial Sequence; identical to SEQ ID NO: 47242
  neuraminidase__InfluenzaA__ADD97214

SEQ ID NO: 48846 - RNA, 1410 nt, Artificial Sequence
  neuraminidase__InfluenzaA__ADD97224
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48847 - RNA, 1410 nt, Artificial Sequence; identical to SEQ ID NO: 47242
  neuraminidase__InfluenzaA__ADD97234

SEQ ID NO: 48848 - RNA, 1410 nt, Artificial Sequence; identical to SEQ ID NO: 48837
  neuraminidase__InfluenzaA__ADD97244

SEQ ID NO: 48849 - RNA, 1410 nt, Artificial Sequence; identical to SEQ ID NO: 48837
  neuraminidase__InfluenzaA__ADD97254

SEQ ID NO: 48850 - RNA, 1410 nt, Artificial Sequence; identical to SEQ ID NO: 47242
  neuraminidase__InfluenzaA__ADD97264

SEQ ID NO: 48851 - RNA, 1410 nt, Artificial Sequence; identical to SEQ ID NO: 48846
  neuraminidase__InfluenzaA__ADD97274

SEQ ID NO: 48852 - RNA, 1410 nt, Artificial Sequence
  neuraminidase__InfluenzaA__ADD97284
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucugcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48853 - RNA, 1410 nt, Artificial Sequence; identical to SEQ ID NO: 47242
  neuraminidase__InfluenzaA__ADD97294

SEQ ID NO: 48854 - RNA, 1410 nt, Artificial Sequence
  neuraminidase__InfluenzaA__ADD97314
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaacaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48855 - RNA, 1410 nt, Artificial Sequence; identical to SEQ ID NO: 48286
  neuraminidase__InfluenzaA__ADD97334

SEQ ID NO: 48856 - RNA, 1410 nt, Artificial Sequence; identical to SEQ ID NO: 47439
  neuraminidase__InfluenzaA__ADD97344

SEQ ID NO: 48857 - RNA, 1410 nt, Artificial Sequence; identical to SEQ ID NO: 48286
  neuraminidase__InfluenzaA__ADD97354

SEQ ID NO: 48858 - RNA, 1410 nt, Artificial Sequence
  neuraminidase__InfluenzaA__ADD97384
augaauccaaaccaaaagauaauaaccauugguucggucuguaugacaauuggaauggcuaacuuaauauuacaaauuggaaacauaaucucaauauggauuagccacacaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48859 - RNA, 1410 nt, Artificial Sequence
  neuraminidase__InfluenzaA__ADD97394
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagccagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48860 - RNA, 1410 nt, Artificial Sequence; identical to SEQ ID NO: 47439
  neuraminidase__InfluenzaA__ADD97404

SEQ ID NO: 48861 - RNA, 1410 nt, Artificial Sequence; identical to SEQ ID NO: 48286
  neuraminidase__InfluenzaA__ADD97424

SEQ ID NO: 48862 - RNA, 1410 nt, Artificial Sequence; identical to SEQ ID NO: 47242
  neuraminidase__InfluenzaA__ADD97434

SEQ ID NO: 48863 - RNA, 1410 nt, Artificial Sequence
  neuraminidase__InfluenzaA__ADD97444
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48864 - RNA, 1410 nt, Artificial Sequence
  neuraminidase__InfluenzaA__ADD97454
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuauuaguggaugggcuauauacaguaaagacaacaguauaagaaucgguuccaagggggauguguuugucauaagggaaccauucauaucaugcucccccuuggaaugcagaaccuucuucuugacucaaggggccuugcuaagugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48865 - RNA, 1410 nt, Artificial Sequence
  neuraminidase__InfluenzaA__ADD97464
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaacaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48866 - RNA, 1410 nt, Artificial Sequence
  neuraminidase__InfluenzaA__ADD97474
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccuccccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48867 - RNA, 1410 nt, Artificial Sequence; identical to SEQ ID NO: 47242
  neuraminidase__InfluenzaA__ADD97484

SEQ ID NO: 48868 - RNA, 1410 nt, Artificial Sequence
  neuraminidase__InfluenzaA__ADD97494
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccucggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48869 - RNA, 1410 nt, Artificial Sequence; identical to SEQ ID NO: 47242
  neuraminidase__InfluenzaA__ADD97504

SEQ ID NO: 48870 - RNA, 1410 nt, Artificial Sequence
  neuraminidase__InfluenzaA__ADD97514
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugcguaugcagagauaacuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48871 - RNA, 1410 nt, Artificial Sequence; identical to SEQ ID NO: 48854
  neuraminidase__InfluenzaA__ADD97534

SEQ ID NO: 48872 - RNA, 1410 nt, Artificial Sequence; identical to SEQ ID NO: 47439
  neuraminidase__InfluenzaA__ADD97544

SEQ ID NO: 48873 - RNA, 1410 nt, Artificial Sequence
  neuraminidase__InfluenzaA__ADD97554
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaggagaacacaaucuggacuagcgggagcagcauauccuuuugugguguaaacagugacacuguggguuggucuuggccagacggugcugaguugcccuuuaccauugacaaguaa

SEQ ID NO: 48874 - RNA, 1410 nt, Artificial Sequence; identical to SEQ ID NO: 48858
  neuraminidase__InfluenzaA__ADD97564

SEQ ID NO: 48875 - RNA, 1410 nt, Artificial Sequence; identical to SEQ ID NO: 47242
  neuraminidase__InfluenzaA__ADD97574

SEQ ID NO: 48876 - RNA, 1410 nt, Artificial Sequence; identical to SEQ ID NO: 47242
  neuraminidase__InfluenzaA__ADD97584

SEQ ID NO: 48877 - RNA, 1410 nt, Artificial Sequence
  neuraminidase__InfluenzaA__ADD97681
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaauaaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaauggauggacugggacagacaauaacuucucaauaaagcaagauaucguaggaauaaaugaauggucaggauauagcgggaguuuuguucagcacccagaacuaacagggcuggauuguauaagaccuugcuucuggguugaacuaaucagagggcgacccaaagagaacacaaucuggacuagcgggagcagcauauccuuuugugguauaaacagugacacuguggguuggucuuggccagacggugcugaguugccauuuaccauugacaaguaa

SEQ ID NO: 48878 - RNA, 1410 nt, Artificial Sequence
  neuraminidase__InfluenzaA__ADD97691
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauauggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48879 - RNA, 1410 nt, Artificial Sequence; identical to SEQ ID NO: 48379
  neuraminidase__InfluenzaA__ADD97701

SEQ ID NO: 48880 - RNA, 1410 nt, Artificial Sequence
  neuraminidase__InfluenzaA__ADD97891
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaccaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48881 - RNA, 1410 nt, Artificial Sequence; identical to SEQ ID NO: 47439
  neuraminidase__InfluenzaA__ADD97901

SEQ ID NO: 48882 - RNA, 1410 nt, Artificial Sequence; identical to SEQ ID NO: 48870
  neuraminidase__InfluenzaA__ADD97911

SEQ ID NO: 48883 - RNA, 1410 nt, Artificial Sequence
  neuraminidase__InfluenzaA__ADD97921
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuuaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48884 - RNA, 1410 nt, Artificial Sequence
  neuraminidase__InfluenzaA__ADD97931
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcugaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48885 - RNA, 1410 nt, Artificial Sequence
  neuraminidase__InfluenzaA__ADD97941
augaauccaaaccaaaagauaauaaccauugguucggucuguauaacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48886 - RNA, 1410 nt, Artificial Sequence
  neuraminidase__InfluenzaA__ADD97951
augaauccaaaccaaaagauaauaaccauuaguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccaucaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48887 - RNA, 1410 nt, Artificial Sequence
  neuraminidase__InfluenzaA__ADD97961
augaauccaaaccaaaagauaauaaccauugguucggucuguaugacaauugggaugguuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaaugccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48888 - RNA, 1410 nt, Artificial Sequence; identical to SEQ ID NO: 48878
  neuraminidase__InfluenzaA__ADD97971

SEQ ID NO: 48889 - RNA, 1410 nt, Artificial Sequence; identical to SEQ ID NO: 47439
  neuraminidase__InfluenzaA__ADD97981

SEQ ID NO: 48890 - RNA, 1410 nt, Artificial Sequence
  neuraminidase__InfluenzaA__ADD97991
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaauacuuggguaaaucagacauauguuaacaucagcaacaccaacuuugcugcuggacagucagugguuuccgugaaauuagcgggcaauucuucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggauugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48891 - RNA, 1410 nt, Artificial Sequence
  neuraminidase__InfluenzaA__ADD98001
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacugucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48892 - RNA, 1410 nt, Artificial Sequence
  neuraminidase__InfluenzaA__ADD98011
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuagcucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48893 - RNA, 1410 nt, Artificial Sequence; identical to SEQ ID NO: 47306
  neuraminidase__InfluenzaA__ADD98031

SEQ ID NO: 48894 - RNA, 1410 nt, Artificial Sequence; identical to SEQ ID NO: 48891
  neuraminidase__InfluenzaA__ADD98041

SEQ ID NO: 48895 - RNA, 1410 nt, Artificial Sequence; identical to SEQ ID NO: 47439
  neuraminidase__InfluenzaA__ADD98051

SEQ ID NO: 48896 - RNA, 1410 nt, Artificial Sequence; identical to SEQ ID NO: 47242
  neuraminidase__InfluenzaA__ADD98061

SEQ ID NO: 48897 - RNA, 1410 nt, Artificial Sequence; identical to SEQ ID NO: 47242
  neuraminidase__InfluenzaA__ADD98071

SEQ ID NO: 48898 - RNA, 1410 nt, Artificial Sequence
  neuraminidase__InfluenzaA__ADD98081
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcauugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48899 - RNA, 1410 nt, Artificial Sequence
  neuraminidase__InfluenzaA__ADD98091
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaagccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48900 - RNA, 1410 nt, Artificial Sequence
  neuraminidase__InfluenzaA__ADD98101
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaaacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucugucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48901 - RNA, 1410 nt, Artificial Sequence
  neuraminidase__InfluenzaA__ADD98111
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuuccggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuuaggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48902 - RNA, 1410 nt, Artificial Sequence
  neuraminidase__InfluenzaA__ADD98121
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguauccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48903 - RNA, 1410 nt, Artificial Sequence; identical to SEQ ID NO: 47242
  neuraminidase__InfluenzaA__ADD98131

SEQ ID NO: 48904 - RNA, 1410 nt, Artificial Sequence; identical to SEQ ID NO: 47242
  neuraminidase__InfluenzaA__ADD98141

SEQ ID NO: 48905 - RNA, 1410 nt, Artificial Sequence; identical to SEQ ID NO: 48899
  neuraminidase__InfluenzaA__ADD98151

SEQ ID NO: 48906 - RNA, 1410 nt, Artificial Sequence
  neuraminidase__InfluenzaA__ADD98161
augaauccaaaccaaaagauaauaaccauugguucggucuguaugacaauuggaauggcuaacuuaauauuacaaauuggaaacauaaucucaauauggauuagccacacaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuaggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48907 - RNA, 1410 nt, Artificial Sequence
  neuraminidase__InfluenzaA__ADD98171
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagacagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcucuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48908 - RNA, 1410 nt, Artificial Sequence
  neuraminidase__InfluenzaA__ADD98181
augaauccaaaccaaaagauaauaaccauugguucggucuguaugacaauuggaauggcuaacuuaauauuacaaauuggaaacaugaucucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcagcugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48909 - RNA, 1410 nt, Artificial Sequence
  neuraminidase__InfluenzaA__ADD98201
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48910 - RNA, 1410 nt, Artificial Sequence
  neuraminidase__InfluenzaA__ADD98211
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagagcuggagaaacaacauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48911 - RNA, 1410 nt, Artificial Sequence
  neuraminidase__InfluenzaA__ADE20324
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggagugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48912 - RNA, 1410 nt, Artificial Sequence; identical to SEQ ID NO: 48465
  neuraminidase__InfluenzaA__ADE20334

SEQ ID NO: 48913 - RNA, 1410 nt, Artificial Sequence; identical to SEQ ID NO: 48465
  neuraminidase__InfluenzaA__ADE20344

SEQ ID NO: 48914 - RNA, 1410 nt, Artificial Sequence; identical to SEQ ID NO: 48465
  neuraminidase__InfluenzaA__ADE20354

SEQ ID NO: 48915 - RNA, 1410 nt, Artificial Sequence; identical to SEQ ID NO: 48465
  neuraminidase__InfluenzaA__ADE20378

SEQ ID NO: 48916 - RNA, 1410 nt, Artificial Sequence; identical to SEQ ID NO: 48465
  neuraminidase__InfluenzaA__ADE20391

SEQ ID NO: 48917 - RNA, 1410 nt, Artificial Sequence; identical to SEQ ID NO: 48465
  neuraminidase__InfluenzaA__ADE20631

SEQ ID NO: 48918 - RNA, 1410 nt, Artificial Sequence; identical to SEQ ID NO: 48465
  neuraminidase__InfluenzaA__ADE20641

SEQ ID NO: 48919 - RNA, 1410 nt, Artificial Sequence
  neuraminidase__InfluenzaA__ADE20651
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48920 - RNA, 1410 nt, Artificial Sequence; identical to SEQ ID NO: 48465
  neuraminidase__InfluenzaA__ADE20661

SEQ ID NO: 48921 - RNA, 1410 nt, Artificial Sequence; identical to SEQ ID NO: 48465
  neuraminidase__InfluenzaA__ADE20671

SEQ ID NO: 48922 - RNA, 1410 nt, Artificial Sequence; identical to SEQ ID NO: 48465
  neuraminidase__InfluenzaA__ADE20681

SEQ ID NO: 48923 - RNA, 1410 nt, Artificial Sequence
  neuraminidase__InfluenzaA__ADE20701
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48924 - RNA, 1410 nt, Artificial Sequence; identical to SEQ ID NO: 48465
  neuraminidase__InfluenzaA__ADE20711

SEQ ID NO: 48925 - RNA, 1410 nt, Artificial Sequence
  neuraminidase__InfluenzaA__ADE20721
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagugggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacagguaa

SEQ ID NO: 48926 - RNA, 1410 nt, Artificial Sequence; identical to SEQ ID NO: 48923
  neuraminidase__InfluenzaA__ADE20731

SEQ ID NO: 48927 - RNA, 1410 nt, Artificial Sequence; identical to SEQ ID NO: 48465
  neuraminidase__InfluenzaA__ADE20741

SEQ ID NO: 48928 - RNA, 1410 nt, Artificial Sequence; identical to SEQ ID NO: 48465
  neuraminidase__InfluenzaA__ADE20751

SEQ ID NO: 48929 - RNA, 1410 nt, Artificial Sequence; identical to SEQ ID NO: 48923
  neuraminidase__InfluenzaA__ADE20761

SEQ ID NO: 48930 - RNA, 1410 nt, Artificial Sequence; identical to SEQ ID NO: 48923
  neuraminidase__InfluenzaA__ADE20781

SEQ ID NO: 48931 - RNA, 1410 nt, Artificial Sequence; identical to SEQ ID NO: 47242
  neuraminidase__InfluenzaA__ADE20791

SEQ ID NO: 48932 - RNA, 1410 nt, Artificial Sequence
  neuraminidase__InfluenzaA__ADE20801
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaagucagucgaaaugaaugccccuaauuaucacuaugaggaaugcuccuguuauccugauucuagugaaaucacaugugugugcagggauaacuggcauggcucgaaucggccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48933 - RNA, 1410 nt, Artificial Sequence
  neuraminidase__InfluenzaA__ADE20811
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucguccaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48934 - RNA, 1410 nt, Artificial Sequence; identical to SEQ ID NO: 48286
  neuraminidase__InfluenzaA__ADE20821

SEQ ID NO: 48935 - RNA, 1410 nt, Artificial Sequence; identical to SEQ ID NO: 47242
  neuraminidase__InfluenzaA__ADE20831

SEQ ID NO: 48936 - RNA, 1410 nt, Artificial Sequence; identical to SEQ ID NO: 47242
  neuraminidase__InfluenzaA__ADE20841

SEQ ID NO: 48937 - RNA, 1410 nt, Artificial Sequence; identical to SEQ ID NO: 47242
  neuraminidase__InfluenzaA__ADE20851

SEQ ID NO: 48938 - RNA, 1410 nt, Artificial Sequence; identical to SEQ ID NO: 48858
  neuraminidase__InfluenzaA__ADE20861

SEQ ID NO: 48939 - RNA, 1410 nt, Artificial Sequence
  neuraminidase__InfluenzaA__ADE20871
augaauccaaaccaaaagauaauaaccauugguucggucugcaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugcccccaacuaucacuaugaggaaugcuccugcuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48940 - RNA, 1410 nt, Artificial Sequence; identical to SEQ ID NO: 48854
  neuraminidase__InfluenzaA__ADE20881

SEQ ID NO: 48941 - RNA, 1410 nt, Artificial Sequence
  neuraminidase__InfluenzaA__ADE20891
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcaggaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagcgggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48942 - RNA, 1410 nt, Artificial Sequence; identical to SEQ ID NO: 48863
  neuraminidase__InfluenzaA__ADE20901

SEQ ID NO: 48943 - RNA, 1410 nt, Artificial Sequence; identical to SEQ ID NO: 48899
  neuraminidase__InfluenzaA__ADE20911

SEQ ID NO: 48944 - RNA, 1410 nt, Artificial Sequence; identical to SEQ ID NO: 47242
  neuraminidase__InfluenzaA__ADE20921

SEQ ID NO: 48945 - RNA, 1410 nt, Artificial Sequence
  neuraminidase__InfluenzaA__ADE20931
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugcguaugcagagauaacuggcauggcucgaaucgaccgugggugucuuucaaccagaaucuggaauaucagauaggauacauaugcaguggaauuuucggagacaauccacguccuaaugauaagacaggcaguugugguccaguauugucuaauggagcaaauggaguaaaaggauuuucauucaaauacggcaaugguguuuggauagggagaacuaaaagcauugguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48946 - RNA, 1410 nt, Artificial Sequence; identical to SEQ ID NO: 47439
  neuraminidase__InfluenzaA__ADE20941

SEQ ID NO: 48947 - RNA, 1410 nt, Artificial Sequence
  neuraminidase__InfluenzaA__ADE20951
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucugguccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagaugucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48948 - RNA, 1410 nt, Artificial Sequence
  neuraminidase__InfluenzaA__ADE20961
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguauccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacgacauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48949 - RNA, 1410 nt, Artificial Sequence; identical to SEQ ID NO: 48902
  neuraminidase__InfluenzaA__ADE20971

SEQ ID NO: 48950 - RNA, 1410 nt, Artificial Sequence; identical to SEQ ID NO: 48858
  neuraminidase__InfluenzaA__ADE20981

SEQ ID NO: 48951 - RNA, 1410 nt, Artificial Sequence
  neuraminidase__InfluenzaA__ADE20991
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 48952 - RNA, 1410 nt, Artificial Sequence
  neuraminidase__InfluenzaA__ADE21001
augaauccaaaccaaaagauaauaaccauugguucggucuguaugacaauuggaauggcuaacuuaauauuacaaauuggaaacauaaucucaauauggauuagccacacaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuaucauaagggaaccauucauaucaugcucccccuuggaaugcagaaccuucuucuugacucagggggccuugcuaaaugacaaacauuccaauggaaccauuaaagacaggagcccauaucgaacccuaaugagcuguccuauuggugaaguucccucuccauacaacucaagauuugagucagucgcuuggucagcaagugccugucaugauggcaucaauuggcuaacaauuggaauuucuggcccagacaauggggcaguggcuguguuaaaguacaacggcauaauaacagacacuaucaagaguuggagaaacaauauauuaagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48953 - RNA, 1410 nt, Artificial Sequence
  neuraminidase__InfluenzaA__ADE21011
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcugacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48954 - RNA, 1410 nt, Artificial Sequence; identical to SEQ ID NO: 47439
  neuraminidase__InfluenzaA__ADE21021

SEQ ID NO: 48955 - RNA, 1410 nt, Artificial Sequence
  neuraminidase__InfluenzaA__ADE21031
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaauucaagauuugagucagucgcuuggucagcaagugcuugucaugauggcaucaauuggcuaacaauuggaauuucuggcccagacaauggggcaguggcuguguuaaaguacaacggcauaauaacagacacugucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauauaguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48956 - RNA, 1410 nt, Artificial Sequence
  neuraminidase__InfluenzaA__ADE21041
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaaucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48957 - RNA, 1410 nt, Artificial Sequence; identical to SEQ ID NO: 48899
  neuraminidase__InfluenzaA__ADE21051

SEQ ID NO: 48958 - RNA, 1410 nt, Artificial Sequence
  neuraminidase__InfluenzaA__ADE21071
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaauggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48959 - RNA, 1413 nt, Artificial Sequence; identical to SEQ ID NO: 47719
  neuraminidase__InfluenzaA__ADE28752

SEQ ID NO: 48960 - RNA, 1413 nt, Artificial Sequence
  neuraminidase__InfluenzaA__ADE28763
augaauccaaaucaaaagauaauaaccauuggaucaaucaguauagcaaucggaauaauuagucuaauguugcaaauaggaaauauuauuucaauaugggcuagucacucaauccaaacuggaagucaaaacaacacuggaauaugcaaccaaagaaucaucacauaugaaaacagcaccugggugaaucacacauauguuaauauuaacaacacuaauguuguugcuggagaggacaaaacgucagugacauuggccggcaauucaucucuuuguucuaucaguggaugggcuauauacacaaaagacaacagcauaagaauuggcuccaaaggagauguuuuugucauaagagaaccuuucauaucauguucucacuuggaaugcagaaccuuuuuucugacccaaggcgcucuauuaaaugacaaacauucaaaugggaccguaaaggacagaaguccuuauagggccuuaaugagcuguccucuaggugaagcuccguccccauacaauucaaaguucgaaucaguugcauggucagcaagcgcaugccaugauggcaugggcugguuaacaaucggaauuucugguccagacaauggagcuguggcuguacuaaaauacaacggaauaauaacuggaaccauaaaaaguuggaaaaagcaaauauuaagaacacaagagucugaaugugucuguaugaacgggucauguuucaccauaaugaccgauggcccgaguaauaaggccgccucguacaaaauuuucaagaucgaaaaggggaagguuacuaaaucaauagaguugaaugcacccaauuuuuauuaugaggaaugcuccuguuacccagacacuggcauagugauguguguaugcagggacaacuggcaugguucaaaucgaccuugggugucuuuuaaucaaaacuuggauuaucaaauaggauacaucugcaguggaguguuuggugacaauccgcgucccgaagauggagagggcagcugcaauccagugacuguugauggagcaaacggaguaaaaggguuuucauacaaauaugguaaugguguuuggauaggaaggaccaaaaguaacagacuuagaaagggguuugagaugauuugggauccuaauggauggacaaauaccgacagugauuucucagugaaacaggauguuguagcaauaacugauuggucaggguacagcggaaguuucguccaacauccugaguuaacaggauuggacuguauaagaccuugcuucuggguugaguuagucagagggcugccuagagaaaauacaacaaucuggacuagugggagcagcauuucuuuuuguggcguuaauagugauacugcaaacuggucuuggccagacggugcugaguugccguucaccauugacaaguag

SEQ ID NO: 48961 - RNA, 1410 nt, Artificial Sequence; identical to SEQ ID NO: 48465
  neuraminidase__InfluenzaA__ADE28773

SEQ ID NO: 48962 - RNA, 1410 nt, Artificial Sequence; identical to SEQ ID NO: 48465
  neuraminidase__InfluenzaA__ADE28783

SEQ ID NO: 48963 - RNA, 1410 nt, Artificial Sequence
  neuraminidase__InfluenzaA__ADE28803
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacacuaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcguaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48964 - RNA, 1410 nt, Artificial Sequence; identical to SEQ ID NO: 47242
  neuraminidase__InfluenzaA__ADE28813

SEQ ID NO: 48965 - RNA, 1410 nt, Artificial Sequence; identical to SEQ ID NO: 47242
  neuraminidase__InfluenzaA__ADE28823

SEQ ID NO: 48966 - RNA, 1410 nt, Artificial Sequence
  neuraminidase__InfluenzaA__ADE28843
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuguuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaauuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48967 - RNA, 1410 nt, Artificial Sequence
  neuraminidase__InfluenzaA__ADE28853
augaauccaaaccaaaagauaauaaccauuguuucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48968 - RNA, 1410 nt, Artificial Sequence; identical to SEQ ID NO: 48966
  neuraminidase__InfluenzaA__ADE28884

SEQ ID NO: 48969 - RNA, 1410 nt, Artificial Sequence
  neuraminidase__InfluenzaA__ADE28894
augaauccaaaccaaaagauaauaaccauugguucggucuguaugacaauuggaauggcuaacuuaauauuacaaauuggaaacauaaucucaauauggauuagccacucaguucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48970 - RNA, 1410 nt, Artificial Sequence
  neuraminidase__InfluenzaA__ADE28904
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggauugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccguuuaccauugacaaguaa

SEQ ID NO: 48971 - RNA, 1410 nt, Artificial Sequence
  neuraminidase__InfluenzaA__ADE28914
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacagggaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48972 - RNA, 1410 nt, Artificial Sequence; identical to SEQ ID NO: 48286
  neuraminidase__InfluenzaA__ADE28924

SEQ ID NO: 48973 - RNA, 1410 nt, Artificial Sequence
  neuraminidase__InfluenzaA__ADE28934
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguauaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48974 - RNA, 1410 nt, Artificial Sequence
  neuraminidase__InfluenzaA__ADE28954
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugcguaugcagagauaauuggcauggcucgaaucgaccgugggugucuuucaaccagaaucuggaauaucagauaggauacauaugcaguggaauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48975 - RNA, 1410 nt, Artificial Sequence
  neuraminidase__InfluenzaA__ADE28964
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaucaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaauuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48976 - RNA, 1410 nt, Artificial Sequence; identical to SEQ ID NO: 48838
  neuraminidase__InfluenzaA__ADE28974

SEQ ID NO: 48977 - RNA, 1410 nt, Artificial Sequence
  neuraminidase__InfluenzaA__ADE29004
augaauccaaaccaaaagauaauaaccauugguucggucuguaugacaauuggauuggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaaaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48978 - RNA, 1410 nt, Artificial Sequence
  neuraminidase__InfluenzaA__ADE29014
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaccagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48979 - RNA, 1410 nt, Artificial Sequence
  neuraminidase__InfluenzaA__ADE29024
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuccugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccagugucgucuaauggagcaaauggaguaaaaggauuuucauucaaauacggcaaugguguuuggauagggagaacuaaaagcauuaguucaagaaacgguuuugagaugauuugggauccgaacggauggaaugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48980 - RNA, 1410 nt, Artificial Sequence
  neuraminidase__InfluenzaA__ADE29034
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggcgaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 48981 - RNA, 1410 nt, Artificial Sequence; identical to SEQ ID NO: 48035
  neuraminidase__InfluenzaA__ADE29044

SEQ ID NO: 48982 - RNA, 1410 nt, Artificial Sequence; identical to SEQ ID NO: 48980
  neuraminidase__InfluenzaA__ADE29054

SEQ ID NO: 48983 - RNA, 1410 nt, Artificial Sequence
  neuraminidase__InfluenzaA__ADE29064
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaagaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggggcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48984 - RNA, 1410 nt, Artificial Sequence
  neuraminidase__InfluenzaA__ADE29087
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcaaaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48985 - RNA, 1410 nt, Artificial Sequence; identical to SEQ ID NO: 47232
  neuraminidase__InfluenzaA__ADE29097

SEQ ID NO: 48986 - RNA, 1410 nt, Artificial Sequence; identical to SEQ ID NO: 48109
  neuraminidase__InfluenzaA__ADE34194

SEQ ID NO: 48987 - RNA, 1410 nt, Artificial Sequence; identical to SEQ ID NO: 48087
  neuraminidase__InfluenzaA__ADE34205

SEQ ID NO: 48988 - RNA, 1410 nt, Artificial Sequence
  neuraminidase__InfluenzaA__ADE34216
augaauccaaaucaaaagauaauaacgauuggcucuguuucucucaccauuuccacaauaugcuucuucaugcaaauugccaucuugguaacuacuguaacauugcauuucaagcaauaugaauucaacucccccccaaacaaccaagugaugcugugugaaccaacaauaauagaaaggaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucuggguaacaagagaaccuuaugugucaugcgauccugacaaguguuaucaauuugcccuuggacagggaacaacacuaaacaacgugcauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagacauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacacccagaaaaaacgacagcuccagcaguagccauuguuuggauccuaacaaugaagaagguggucauggagugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcgaacaucaaucucaugccuauauaa

SEQ ID NO: 48989 - RNA, 1410 nt, Artificial Sequence; identical to SEQ ID NO: 48109
  neuraminidase__InfluenzaA__ADE34227

SEQ ID NO: 48990 - RNA, 1410 nt, Artificial Sequence
  neuraminidase__InfluenzaA__ADE34238
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucagggagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguucggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggauaucaaucucaugccuauauaa

SEQ ID NO: 48991 - RNA, 1410 nt, Artificial Sequence
  neuraminidase__InfluenzaA__ADE34260
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauauuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugucuauauaa

SEQ ID NO: 48992 - RNA, 1410 nt, Artificial Sequence
  neuraminidase__InfluenzaA__ADE34271
augaauccaaaucagaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguucggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaaguuuuguggaccucaaacaguauuguuguguuuuguggcaccucagguacauauggaacaggcucauggccugauggggcggauaucaaucucaugccuauauaa

SEQ ID NO: 48993 - RNA, 1410 nt, Artificial Sequence
  neuraminidase__InfluenzaA__ADE45502
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcugcccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 48994 - RNA, 1410 nt, Artificial Sequence; identical to SEQ ID NO: 47242
  neuraminidase__InfluenzaA__ADE45504

SEQ ID NO: 48995 - RNA, 1410 nt, Artificial Sequence
  neuraminidase__InfluenzaA__ADE45506
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagugucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 48996 - RNA, 1410 nt, Artificial Sequence; identical to SEQ ID NO: 47379
  neuraminidase__InfluenzaA__ADE45508

SEQ ID NO: 48997 - RNA, 1410 nt, Artificial Sequence; identical to SEQ ID NO: 47379
  neuraminidase__InfluenzaA__ADE45510

SEQ ID NO: 48998 - RNA, 1410 nt, Artificial Sequence
  neuraminidase__InfluenzaA__ADE45512
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 48999 - RNA, 1410 nt, Artificial Sequence
  neuraminidase__InfluenzaA__ADE45514
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauuccaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugcgguguaaacagugacacuguggguuggucuuggccagacggugcugaguugccauuuaccauugacaaguaa

SEQ ID NO: 49000 - RNA, 1410 nt, Artificial Sequence
  neuraminidase__InfluenzaA__ADE45516
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguuuaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49001 - RNA, 1410 nt, Artificial Sequence
  neuraminidase__InfluenzaA__ADF10069
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaagggaccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49002 - RNA, 1410 nt, Artificial Sequence; identical to SEQ ID NO: 47242
  neuraminidase__InfluenzaA__ADF10079

SEQ ID NO: 49003 - RNA, 1410 nt, Artificial Sequence
  neuraminidase__InfluenzaA__ADF10089
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcugcuggacagucaguggucuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49004 - RNA, 1410 nt, Artificial Sequence
  neuraminidase__InfluenzaA__ADF10099
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcaguauauccuuuugugguguaaacagugacacuguggguuggucuuggccagacggugcugaguugccauuuaccauugacaaguaa

SEQ ID NO: 49005 - RNA, 1410 nt, Artificial Sequence
  neuraminidase__InfluenzaA__ADF10109
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaauugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcaguauauccuuuugugguguaaacagugacacuguggguuggucuuggccagacggugcugaguugccauuuaccauugacaaguaa

SEQ ID NO: 49006 - RNA, 1410 nt, Artificial Sequence
  neuraminidase__InfluenzaA__ADF10129
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcccugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49007 - RNA, 1410 nt, Artificial Sequence
  neuraminidase__InfluenzaA__ADF10146
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccaggaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuuguggcguaaacagugacacuguggguuggucuuggccagacggugcugaguugccauuuaccauugacaaguaa

SEQ ID NO: 49008 - RNA, 1410 nt, Artificial Sequence
  neuraminidase__InfluenzaA__ADF10166
augaauccaaaccaaaagauaauaaccauugguucggucuguaugauaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaagguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 49009 - RNA, 1410 nt, Artificial Sequence; identical to SEQ ID NO: 49008
  neuraminidase__InfluenzaA__ADF10176

SEQ ID NO: 49010 - RNA, 1410 nt, Artificial Sequence; identical to SEQ ID NO: 49008
  neuraminidase__InfluenzaA__ADF10192

SEQ ID NO: 49011 - RNA, 1410 nt, Artificial Sequence; identical to SEQ ID NO: 47306
  neuraminidase__InfluenzaA__ADF10247

SEQ ID NO: 49012 - RNA, 1410 nt, Artificial Sequence; identical to SEQ ID NO: 49008
  neuraminidase__InfluenzaA__ADF10290

SEQ ID NO: 49013 - RNA, 1410 nt, Artificial Sequence
  neuraminidase__InfluenzaA__ADF10304
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcuggguugccauuuaccauugacaaguaa

SEQ ID NO: 49014 - RNA, 1410 nt, Artificial Sequence; identical to SEQ ID NO: 47306
  neuraminidase__InfluenzaA__ADF10340

SEQ ID NO: 49015 - RNA, 1410 nt, Artificial Sequence; identical to SEQ ID NO: 47306
  neuraminidase__InfluenzaA__ADF10361

SEQ ID NO: 49016 - RNA, 1410 nt, Artificial Sequence; identical to SEQ ID NO: 49008
  neuraminidase__InfluenzaA__ADF10371

SEQ ID NO: 49017 - RNA, 1410 nt, Artificial Sequence; identical to SEQ ID NO: 49008
  neuraminidase__InfluenzaA__ADF10407

SEQ ID NO: 49018 - RNA, 1410 nt, Artificial Sequence
  neuraminidase__InfluenzaA__ADF10472
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaacgauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49019 - RNA, 1410 nt, Artificial Sequence; identical to SEQ ID NO: 49008
  neuraminidase__InfluenzaA__ADF10616

SEQ ID NO: 49020 - RNA, 1410 nt, Artificial Sequence; identical to SEQ ID NO: 49008
  neuraminidase__InfluenzaA__ADF10688

SEQ ID NO: 49021 - RNA, 1410 nt, Artificial Sequence; identical to SEQ ID NO: 49008
  neuraminidase__InfluenzaA__ADF10726

SEQ ID NO: 49022 - RNA, 1410 nt, Artificial Sequence
  neuraminidase__InfluenzaA__ADF10773
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49023 - RNA, 1410 nt, Artificial Sequence
  neuraminidase__InfluenzaA__ADF10837
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggguauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49024 - RNA, 1410 nt, Artificial Sequence; identical to SEQ ID NO: 47242
  neuraminidase__InfluenzaA__ADF10889

SEQ ID NO: 49025 - RNA, 1410 nt, Artificial Sequence
  neuraminidase__InfluenzaA__ADF10947
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49026 - RNA, 1410 nt, Artificial Sequence
  neuraminidase__InfluenzaA__ADF11010
augaauccaaaccaaaagauaauaaccauugguucgguuuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49027 - RNA, 1410 nt, Artificial Sequence
  neuraminidase__InfluenzaA__ADF27355
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaaggaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauggggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugauacuguggguuggucuuggccagacggugcugaguugccauuuaccauugacaaguaa

SEQ ID NO: 49028 - RNA, 1410 nt, Artificial Sequence
  neuraminidase__InfluenzaA__ADF27356
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaaacgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaaggaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugauacuguggguuggucuuggccagacggugcugaguugccauuuaccauugacaaguaa

SEQ ID NO: 49029 - RNA, 1410 nt, Artificial Sequence; identical to SEQ ID NO: 47596
  neuraminidase__InfluenzaA__ADF27357

SEQ ID NO: 49030 - RNA, 1410 nt, Artificial Sequence
  neuraminidase__InfluenzaA__ADF27358
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacuggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49031 - RNA, 1410 nt, Artificial Sequence
  neuraminidase__InfluenzaA__ADF27360
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacggacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49032 - RNA, 1410 nt, Artificial Sequence
  neuraminidase__InfluenzaA__ADF27361
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugacugauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49033 - RNA, 1410 nt, Artificial Sequence; identical to SEQ ID NO: 48319
  neuraminidase__InfluenzaA__ADF27362

SEQ ID NO: 49034 - RNA, 1410 nt, Artificial Sequence
  neuraminidase__InfluenzaA__ADF27363
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucauguucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49035 - RNA, 1410 nt, Artificial Sequence; identical to SEQ ID NO: 47649
  neuraminidase__InfluenzaA__ADF27364

SEQ ID NO: 49036 - RNA, 1410 nt, Artificial Sequence
  neuraminidase__InfluenzaA__ADF27365
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49037 - RNA, 1410 nt, Artificial Sequence
  neuraminidase__InfluenzaA__ADF27366
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucaaauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49038 - RNA, 1410 nt, Artificial Sequence
  neuraminidase__InfluenzaA__ADF27382
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugccaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49039 - RNA, 1410 nt, Artificial Sequence; identical to SEQ ID NO: 48319
  neuraminidase__InfluenzaA__ADF27392

SEQ ID NO: 49040 - RNA, 1410 nt, Artificial Sequence
  neuraminidase__InfluenzaA__ADF27402
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacauaagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaauacaaucuggacuagcgggagcagcauauccuuuugugguguaaacagugacacuguggguuggucuuggccagacggugcugaguugccauuuaccauugacaaguaa

SEQ ID NO: 49041 - RNA, 1410 nt, Artificial Sequence
  neuraminidase__InfluenzaA__ADF27422
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuuguaauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49042 - RNA, 1410 nt, Artificial Sequence
  neuraminidase__InfluenzaA__ADF27432
augaauccaaaccaaaagauaauaaccauugguucggucugugugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49043 - RNA, 1410 nt, Artificial Sequence
  neuraminidase__InfluenzaA__ADF27442
augaauccaaaccaaaagauaauaaccauugguucggucuguaugacaauuggaauggcuaacuuaauauuacaaauuggaaacauaauaucaauauggauuagccacucaauucaacuugagaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49044 - RNA, 1410 nt, Artificial Sequence
  neuraminidase__InfluenzaA__ADF27462
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaagcaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggccguauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49045 - RNA, 1410 nt, Artificial Sequence
  neuraminidase__InfluenzaA__ADF27472
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaacggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacggggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49046 - RNA, 1410 nt, Artificial Sequence
  neuraminidase__InfluenzaA__ADF27482
augaauccaaaccaaaagauaauaaccauugguucggucuguaugacaauuggaauggcuaacuuaauauuacaaauuggaaacauaaucucaauauggauuagccacucaauucaacuugggaaucaaaaucagguugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49047 - RNA, 1410 nt, Artificial Sequence
  neuraminidase__InfluenzaA__ADF27492
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaccaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucaaucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacagucuggacuagcgggagcagcauauccuuuugugguguaaacagugacacuguggguuggucuuggccagacggugcugaguugccauuuaccauugacaaguaa

SEQ ID NO: 49048 - RNA, 1410 nt, Artificial Sequence; identical to SEQ ID NO: 48286
  neuraminidase__InfluenzaA__ADF27502

SEQ ID NO: 49049 - RNA, 1410 nt, Artificial Sequence; identical to SEQ ID NO: 47242
  neuraminidase__InfluenzaA__ADF27512

SEQ ID NO: 49050 - RNA, 1410 nt, Artificial Sequence
  neuraminidase__InfluenzaA__ADF27522
augaauccaaaccaaaagauaauaaccauugguucggucuguaugacaauugggauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaauuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49051 - RNA, 1410 nt, Artificial Sequence; identical to SEQ ID NO: 47242
  neuraminidase__InfluenzaA__ADF27532

SEQ ID NO: 49052 - RNA, 1410 nt, Artificial Sequence
  neuraminidase__InfluenzaA__ADF27542
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaacaauuaaagacaggagcccauaucgaacccuaaugagcugcccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49053 - RNA, 1410 nt, Artificial Sequence
  neuraminidase__InfluenzaA__ADF27552
augaauccaaaccaaaagauaauaaccauugguucggucuguaugacaauuggauuggcuaacuuaauauuacaaauuggaaacauaaucucaauauggguuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaaaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49054 - RNA, 1410 nt, Artificial Sequence
  neuraminidase__InfluenzaA__ADF27562
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccaaacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucggccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49055 - RNA, 1410 nt, Artificial Sequence
  neuraminidase__InfluenzaA__ADF27572
augaauccaaaccaaaagauaauaaccauugguucagucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49056 - RNA, 1410 nt, Artificial Sequence
  neuraminidase__InfluenzaA__ADF27582
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcuccccauuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49057 - RNA, 1410 nt, Artificial Sequence; identical to SEQ ID NO: 47242
  neuraminidase__InfluenzaA__ADF27592

SEQ ID NO: 49058 - RNA, 1410 nt, Artificial Sequence
  neuraminidase__InfluenzaA__ADF27602
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagagaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaggggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauagcuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacaaucuggacuagcgggagcagcauauccuuuugugguguaaacagugacacuguggguuggucuuggccagacggugcugaguugccauuuaccauugacaaguaa

SEQ ID NO: 49059 - RNA, 1410 nt, Artificial Sequence; identical to SEQ ID NO: 48273
  neuraminidase__InfluenzaA__ADF27612

SEQ ID NO: 49060 - RNA, 1410 nt, Artificial Sequence; identical to SEQ ID NO: 48983
  neuraminidase__InfluenzaA__ADF27622

SEQ ID NO: 49061 - RNA, 1410 nt, Artificial Sequence; identical to SEQ ID NO: 48977
  neuraminidase__InfluenzaA__ADF27632

SEQ ID NO: 49062 - RNA, 1410 nt, Artificial Sequence; identical to SEQ ID NO: 48286
  neuraminidase__InfluenzaA__ADF27642

SEQ ID NO: 49063 - RNA, 1410 nt, Artificial Sequence; identical to SEQ ID NO: 48286
  neuraminidase__InfluenzaA__ADF27652

SEQ ID NO: 49064 - RNA, 1410 nt, Artificial Sequence
  neuraminidase__InfluenzaA__ADF27662
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaacaauuaaagacaggagcccauaucgaacucuaaugagcugcccuauuggugaaguucccucuccauacaacucaagauuugagucagucgcuuggucagcaagugcuuguaaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49065 - RNA, 1410 nt, Artificial Sequence; identical to SEQ ID NO: 48980
  neuraminidase__InfluenzaA__ADF27672

SEQ ID NO: 49066 - RNA, 1410 nt, Artificial Sequence
  neuraminidase__InfluenzaA__ADF27682
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucugugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacugugaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauuuccuuuugugguguaaacagugacacuguggguuggucuuggccagacggugcugaguugccauuuaccauugacaaguaa

SEQ ID NO: 49067 - RNA, 1410 nt, Artificial Sequence
  neuraminidase__InfluenzaA__ADF27692
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggagcuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49068 - RNA, 1410 nt, Artificial Sequence
  neuraminidase__InfluenzaA__ADF27702
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccaucgacaaguaa

SEQ ID NO: 49069 - RNA, 1410 nt, Artificial Sequence
  neuraminidase__InfluenzaA__ADF27712
augaauccaaaccaaaagauaauaaccauugguucggucuguaugacaauuggaauggcuaacuuaauauuacaaauuggaaacauaaucucaauauggauuagccacucaauccaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucauuaugaggaaugcuccuguuauccugauucuagugaaaucacaugugugugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49070 - RNA, 1410 nt, Artificial Sequence; identical to SEQ ID NO: 48530
  neuraminidase__InfluenzaA__ADF27788

SEQ ID NO: 49071 - RNA, 1410 nt, Artificial Sequence
  neuraminidase__InfluenzaA__ADF27798
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggagcaguggcuguguuaaaguacaacggcauaauaacagacacuaucaagaguuggagaaacaauauauugagaacacaagagucugaaugugcauguguaaaugguucuugcuuuacuguaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaauuuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49072 - RNA, 1410 nt, Artificial Sequence; identical to SEQ ID NO: 48977
  neuraminidase__InfluenzaA__ADF27808

SEQ ID NO: 49073 - RNA, 1410 nt, Artificial Sequence
  neuraminidase__InfluenzaA__ADF27818
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuuuuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49074 - RNA, 1410 nt, Artificial Sequence; identical to SEQ ID NO: 48836
  neuraminidase__InfluenzaA__ADF27838

SEQ ID NO: 49075 - RNA, 1410 nt, Artificial Sequence; identical to SEQ ID NO: 48836
  neuraminidase__InfluenzaA__ADF27848

SEQ ID NO: 49076 - RNA, 1410 nt, Artificial Sequence
  neuraminidase__InfluenzaA__ADF27858
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucaucaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacggugacacuguggguuggucuuggccagacggugcugaguugccauuuaccauugacaaguaa

SEQ ID NO: 49077 - RNA, 1410 nt, Artificial Sequence
  neuraminidase__InfluenzaA__ADF27878
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacggugacacuguggguuggucuuggccagacggugcugaguugccauuuaccauugacaaguaa

SEQ ID NO: 49078 - RNA, 1410 nt, Artificial Sequence
  neuraminidase__InfluenzaA__ADF27888
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuucagugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49079 - RNA, 1410 nt, Artificial Sequence; identical to SEQ ID NO: 47242
  neuraminidase__InfluenzaA__ADF27898

SEQ ID NO: 49080 - RNA, 1410 nt, Artificial Sequence; identical to SEQ ID NO: 48530
  neuraminidase__InfluenzaA__ADF27908

SEQ ID NO: 49081 - RNA, 1410 nt, Artificial Sequence; identical to SEQ ID NO: 48530
  neuraminidase__InfluenzaA__ADF27918

SEQ ID NO: 49082 - RNA, 1410 nt, Artificial Sequence
  neuraminidase__InfluenzaA__ADF27938
augaauccaaaccaaaggauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggcuuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacaggguuggauuguauaagaccuugcuucuggguugaacuaaucagagggcgacccaaagagaacacaaucuggacuagcgggagcagcauguccuuuugugguguaaacagugacacuguggguuggucuuggccagacggugcugaguugccauuuaccauugacaaguaa

SEQ ID NO: 49083 - RNA, 1410 nt, Artificial Sequence
  neuraminidase__InfluenzaA__ADF27948
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauugguuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 49084 - RNA, 1410 nt, Artificial Sequence
  neuraminidase__InfluenzaA__ADF27958
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49085 - RNA, 1410 nt, Artificial Sequence
  neuraminidase__InfluenzaA__ADF27968
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugagacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49086 - RNA, 1410 nt, Artificial Sequence
  neuraminidase__InfluenzaA__ADF27978
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuacccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49087 - RNA, 1410 nt, Artificial Sequence
  neuraminidase__InfluenzaA__ADF27988
augaauccaaaccaaaagauaauaaccauugguucggucuguaugacaauuggauuggcuaacuuaauauuacaaauuggaaacauaaucucaauauggauuagccacucaauucaacuugggaaucaaaaucagauugaaacaugcaaucaaagcgucauuucuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaauugguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucggauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaaaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49088 - RNA, 1410 nt, Artificial Sequence; identical to SEQ ID NO: 47550
  neuraminidase__InfluenzaA__ADF27998

SEQ ID NO: 49089 - RNA, 1410 nt, Artificial Sequence; identical to SEQ ID NO: 47242
  neuraminidase__InfluenzaA__ADF28008

SEQ ID NO: 49090 - RNA, 1410 nt, Artificial Sequence
  neuraminidase__InfluenzaA__ADF28018
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauaugucaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuauaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacaggguuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49091 - RNA, 1410 nt, Artificial Sequence; identical to SEQ ID NO: 47242
  neuraminidase__InfluenzaA__ADF28028

SEQ ID NO: 49092 - RNA, 1410 nt, Artificial Sequence
  neuraminidase__InfluenzaA__ADF28038
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauacguuaacaucagcaacaccaacuuugcuacuggacaguuagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacagacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagauuuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49093 - RNA, 1410 nt, Artificial Sequence; identical to SEQ ID NO: 48658
  neuraminidase__InfluenzaA__ADF28048

SEQ ID NO: 49094 - RNA, 1410 nt, Artificial Sequence; identical to SEQ ID NO: 48286
  neuraminidase__InfluenzaA__ADF28058

SEQ ID NO: 49095 - RNA, 1410 nt, Artificial Sequence
  neuraminidase__InfluenzaA__ADF28068
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaguuccucucucugcccuguuaguggaugggcuauauacaguaaagacaacaguauaagaaucgguuccaagggggauguguuugucauaagggaaccauucauaucaugcucccacuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49096 - RNA, 1410 nt, Artificial Sequence
  neuraminidase__InfluenzaA__ADF28078
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucuuugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49097 - RNA, 1410 nt, Artificial Sequence; identical to SEQ ID NO: 48796
  neuraminidase__InfluenzaA__ADF28088

SEQ ID NO: 49098 - RNA, 1410 nt, Artificial Sequence
  neuraminidase__InfluenzaA__ADF28110
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49099 - RNA, 1410 nt, Artificial Sequence
  neuraminidase__InfluenzaA__ADF28120
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucauuaugaggaaugcuccuguuauccugauucuagcgaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49100 - RNA, 1410 nt, Artificial Sequence; identical to SEQ ID NO: 47439
  neuraminidase__InfluenzaA__ADF29919

SEQ ID NO: 49101 - RNA, 1410 nt, Artificial Sequence
  neuraminidase__InfluenzaA__ADF42692
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaauucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuacuauugacaaguaa

SEQ ID NO: 49102 - RNA, 1410 nt, Artificial Sequence
  neuraminidase__InfluenzaA__ADF42702
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagacccugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49103 - RNA, 1410 nt, Artificial Sequence; identical to SEQ ID NO: 49077
  neuraminidase__InfluenzaA__ADF42712

SEQ ID NO: 49104 - RNA, 1410 nt, Artificial Sequence
  neuraminidase__InfluenzaA__ADF42722
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccguacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagugggagcagcauauccuuuugugguguaaacagugacacuguggguuggucuuggccagacggugcugaguugccauuuaccauugacaaguaa

SEQ ID NO: 49105 - RNA, 1410 nt, Artificial Sequence; identical to SEQ ID NO: 48530
  neuraminidase__InfluenzaA__ADF42732

SEQ ID NO: 49106 - RNA, 1410 nt, Artificial Sequence; identical to SEQ ID NO: 47242
  neuraminidase__InfluenzaA__ADF42742

SEQ ID NO: 49107 - RNA, 1410 nt, Artificial Sequence
  neuraminidase__InfluenzaA__ADF58339
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcaggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggguuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49108 - RNA, 1410 nt, Artificial Sequence
  neuraminidase__InfluenzaA__ADF58348
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacuggaacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49109 - RNA, 1410 nt, Artificial Sequence
  neuraminidase__InfluenzaA__ADF58350
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaccagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49110 - RNA, 1410 nt, Artificial Sequence; identical to SEQ ID NO: 49109
  neuraminidase__InfluenzaA__ADF58352

SEQ ID NO: 49111 - RNA, 1410 nt, Artificial Sequence
  neuraminidase__InfluenzaA__ADF80459
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugacuuucaaccagaaucuggaauaucagauaggauacauaugcagugggauuuucggagacaauccacgcccuaaugauaaaacaggcaguugugguccaguaucgucuaauggagcaaauggagugaaaggauuuucauucaaauacggcaaugguguuuggauagggagaacuaaaagcauuaguucaagaaacgguuuugagaugauuugggauccgaacggauggacugggacagauaauaacuucucaauaaagcaagauaucguaggaauaaaugaguggucaggauauagcgggaguuuuguucagcauccagaacuaacagggcuggauuguauaagaccuugcuucuggguugaacuaaucagaggacgacccaaagagaacacagucuggacuagcgggagcagcauauccuuuugugguguaaacagugacacuguggguuggucuuggccagacggugcugaguugccauuuaccauugacaaguaa

SEQ ID NO: 49112 - RNA, 1410 nt, Artificial Sequence
  neuraminidase__InfluenzaA__ADF80503
augaauccaaaccaaaagauaauaaccauugguucggucuguaugacaauuggaauggcuaacuuaauauuacaaauuggaaacauaaccucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagacaucgugggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49113 - RNA, 1410 nt, Artificial Sequence
  neuraminidase__InfluenzaA__ADF83744
augaauccaaaucaaaagauaauaacgauuggcucuguuucucucaccauuuccacaauaugcuucuucaugcaaauugccaucuugauaacuacuguaacauugcauuucaagcaauaugaauucaacucccccccaaacaaccaagugaugcugugugaaccaacaauaauagaaaaaaacauaacagagauaguguaucugaccaacaccaccauagagaaggaaauaugccccaaacuagcagaauacagaaauuggucaaagccgcaaugugacauuacaggguuugcaccuuuuucuaaggacaauucgauuaggcuuuccgcugguggggacaucugggugacaagagaaccuuaugugucaugcgauccugacaaguguuaucaauuugcccuuggacagggaacaacacuaaacaacguacauucaaauaacacaguacgugauaggaccccuuaucggacccuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguccauacuagcacauugucaggaagugcucagcaugucgaggagugcuccugcuauccucgauauccuggugucagaugugucugcagagacaacuggaaaggauccaauaggcccaucguagauauaaacauaaaggaucauagcauugucuccaguuauguguguucaggacuuguuggagacacacccagaaaaaacgacagcuccagcaguagccauuguuuggauccuaacaaugaggaagguggucauggggugaaaggcugggccuuugaugauggaaaugacguguggaugggaagaacgaucagcgagaagucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaagaaaagaggaaacugaagucuuguggaccucaaacaguauuguuguguuuuguggcaccucagguacauauggaacaggcucauggccugauggggcggacaucaaucucaugccuauauaa

SEQ ID NO: 49114 - RNA, 1410 nt, Artificial Sequence
  neuraminidase__InfluenzaA__ADF83755
augaauccaaaucaaaagauaauaacgauuggcucuguuucucucaccauuuccacaauaugcuucuucaugcaaaccgccauccugauaacuacuguaacauugcauuucaagcaaugugaauucaacucccccccaaacaaccaagugaugcugugugaaccaacaauaauagaaagaaacauaacagagauaguguaucugaccaacaccaccauagagaaggaaauaugccccaaacuagcagaauacagaaauuggucaaagccgcaaugugacauuacaggauuugcaccuuuuucuaaggacaauucgauuaggcuuuccgcugguggggacaucugggugacaagagaaccuuaugugucaugcgauccugacaaguguuaucaauuugcccuuggacagggaacaacgcuaaacaacgugcauucaaauaacacaguacgugauaggaccccuuaucggacucuauugaugaaugaguuagguguuccuuuucaucuggggaccaagcaagugugcauagcaugguccagcucaaguugucacgauggaaaagcauggcugcauguuuguauaacgggggaugauaaaaaugcaacugcuagcuucauuuacaaugggaggcuuguagauaguguuguuucaugguccaaagaaauccucaggacccaggagucagaaugcguuuguaucaauggaacuuguacaguaguaaugacugaugggagugcuucaggaaaagcugauacuaaaauacuauucauugaggaggggaaaaucguucauacuagcacauugucaggaagugcucagcaugucgaggagugcuccugcuauccucgauauccuggugucagaugugucugcagagacaacuggaaaggcuccaauaggcccaucguagauauaaacauaaaggaucauagcauuguuuccaguuauguguguucaggacuuguuggagacacaccuagaaaaaacgacagcuccagcaguagccauuguuuggauccuaacaaugaagaagguggucauggagugaaaggcugggccuuugaugauggaaaugacguguggaugggaagaacgaucagcgagaaaucacgcuuaggguaugaaaccuucaaagucauugaaggcugguccaacccuaaguccaaauugcagauaaauaggcaagucauaguugacagagguaauagguccgguuauucugguauuuucucuguugaaggcaaaagcugcaucaaucggugcuuuuauguggaguugauaaggggaaggaaagaggaaacugaagucuuguggaccucaaacaguauuguuguguuuuguggcaccucagguacauauggaacaggcucauggccugauggggcggacaucaaucucaugccuauauaa

SEQ ID NO: 49115 - RNA, 1410 nt, Artificial Sequence
  neuraminidase__InfluenzaA__ADF83766
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacgacaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49116 - RNA, 1410 nt, Artificial Sequence
  neuraminidase__InfluenzaA__ADF83776
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcuuguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49117 - RNA, 1410 nt, Artificial Sequence
  neuraminidase__InfluenzaA__ADF83786
augaauccaaaccaaaagauaauaaccauugguucggucuguaugacaauuggaauggcuaacuuaauauuacaaauuggaaacauaaucucaauauggauuagccacucaauccaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacggugacacuguggguuggucuuggccagacggugcugaguugccauuuaccauugacaaguaa

SEQ ID NO: 49118 - RNA, 1410 nt, Artificial Sequence
  neuraminidase__InfluenzaA__ADF83796
augaauccaaaccaaaagauaauaaccauugguucggucuguaugacaauuggaauggcuaacuuaauauuacaaauuggaaacauaaucucaauauggauuagccacucaauccaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggaucuucggagacaauccacgcccuaaugauaagacaggcaguugugguccaguaucgucuaauggagcaaauggaguaaaaggauuuucauucaaauacggaaaugguguuuggauagggagaacuaaaagcauuaguucaagaaacgguuuugagaugauuugggauccgaacggauggacugggacagacaauaacuucucaauaaagcaagauaucguaagaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49119 - RNA, 1410 nt, Artificial Sequence
  neuraminidase__InfluenzaA__ADF83806
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguuccuucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49120 - RNA, 1410 nt, Artificial Sequence
  neuraminidase__InfluenzaA__ADF83816
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguccccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacgcuguggguuggucuuggccagacggugcugaguugccauuuaccauugacaaguaa

SEQ ID NO: 49121 - RNA, 1410 nt, Artificial Sequence; identical to SEQ ID NO: 47441
  neuraminidase__InfluenzaA__ADF83826

SEQ ID NO: 49122 - RNA, 1410 nt, Artificial Sequence; identical to SEQ ID NO: 47242
  neuraminidase__InfluenzaA__ADF83836

SEQ ID NO: 49123 - RNA, 1410 nt, Artificial Sequence; identical to SEQ ID NO: 47242
  neuraminidase__InfluenzaA__ADF83846

SEQ ID NO: 49124 - RNA, 1410 nt, Artificial Sequence; identical to SEQ ID NO: 47242
  neuraminidase__InfluenzaA__ADF83856

SEQ ID NO: 49125 - RNA, 1410 nt, Artificial Sequence
  neuraminidase__InfluenzaA__ADF83866
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggcuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49126 - RNA, 1410 nt, Artificial Sequence
  neuraminidase__InfluenzaA__ADF83876
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggaaaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49127 - RNA, 1410 nt, Artificial Sequence
  neuraminidase__InfluenzaA__ADF83888
augaauccaaaccaaaagauaauaaccauugguucggucuguaugacaauuggaauggcuaacuuaauauuacaaauuggaaacauaaucucaauauggaucagccacucaauucaacuugggaaucaaaaucagauugaaacaugcaaucaaagcgucauuacuuaugaaaacaacacuugggugaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcaggaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacggguuugagaugauuugggauccgaacggauggacugggacagacaauagcuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49128 - RNA, 1410 nt, Artificial Sequence
  neuraminidase__InfluenzaA__ADF83898
augaauccaaaccaaaagauaauaaccauugguucggucuguaugacaauuggaauggcuaacuuaauauuacaaauuggaaacauaaucucaauauggauuagccacccaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggguccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaggagaacacaaucuggacuagcgggagcagcauaucuuuuugugguguaaacagugacacuguggguuggucuuggccagacggugcugaguugccauuuaccauugacaaguaa

SEQ ID NO: 49129 - RNA, 1410 nt, Artificial Sequence
  neuraminidase__InfluenzaA__ADF83908
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugugugaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaauagaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucuggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49130 - RNA, 1410 nt, Artificial Sequence
  neuraminidase__InfluenzaA__ADF83918
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagagauaacuggcacggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49131 - RNA, 1410 nt, Artificial Sequence
  neuraminidase__InfluenzaA__ADF84444
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucaguaguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcacggcucgaaucgaccgugggugucuuucaaucagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49132 - RNA, 1410 nt, Artificial Sequence
  neuraminidase__InfluenzaA__ADF84462
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacgggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49133 - RNA, 1410 nt, Artificial Sequence
  neuraminidase__InfluenzaA__ADF84472
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49134 - RNA, 1410 nt, Artificial Sequence
  neuraminidase__InfluenzaA__ADF84482
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucgcaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugaguuggucuuggccagacggugcugaguugccauuuaccauugacaaguaa

SEQ ID NO: 49135 - RNA, 1410 nt, Artificial Sequence
  neuraminidase__InfluenzaA__ADF84492
augaauccaaaccaaaagauaauaaccauugguucggucuguaugacaauuggaauggcuaacuuaauauuacaaauuggaaacauaaucucaauauggauuagccacucaauucaacuugggaaucaagaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49136 - RNA, 1410 nt, Artificial Sequence
  neuraminidase__InfluenzaA__ADF85020
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49137 - RNA, 1410 nt, Artificial Sequence
  neuraminidase__InfluenzaA__ADF87155
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcggguaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49138 - RNA, 1410 nt, Artificial Sequence
  neuraminidase__InfluenzaA__ADF87165
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagacaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucgcaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49139 - RNA, 1410 nt, Artificial Sequence
  neuraminidase__InfluenzaA__ADF87175
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauacagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49140 - RNA, 1410 nt, Artificial Sequence; identical to SEQ ID NO: 47439
  neuraminidase__InfluenzaA__ADF87185

SEQ ID NO: 49141 - RNA, 1410 nt, Artificial Sequence; identical to SEQ ID NO: 49139
  neuraminidase__InfluenzaA__ADF87195

SEQ ID NO: 49142 - RNA, 1410 nt, Artificial Sequence
  neuraminidase__InfluenzaA__ADF87205
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccggaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49143 - RNA, 1410 nt, Artificial Sequence
  neuraminidase__InfluenzaA__ADF87215
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49144 - RNA, 1410 nt, Artificial Sequence
  neuraminidase__InfluenzaA__ADF87235
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucaguugcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49145 - RNA, 1410 nt, Artificial Sequence; identical to SEQ ID NO: 49139
  neuraminidase__InfluenzaA__ADF87245

SEQ ID NO: 49146 - RNA, 1410 nt, Artificial Sequence; identical to SEQ ID NO: 49139
  neuraminidase__InfluenzaA__ADF87265

SEQ ID NO: 49147 - RNA, 1410 nt, Artificial Sequence
  neuraminidase__InfluenzaA__ADF87285
augaauccaaaccaaaagauaauaaccauugguucggucuguaugucaauuggaauggcuaacuuaauauuacaaauuggaaacauaaucucaauauggauuagccacucaauucaacuugggaauaaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcucuuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaaugaaugaauggucaggauauagcgggaguuuuguucagcauccagaacuaacagggcuggauuguaucagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49148 - RNA, 1410 nt, Artificial Sequence
  neuraminidase__InfluenzaA__ADF87295
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49149 - RNA, 1410 nt, Artificial Sequence; identical to SEQ ID NO: 48286
  neuraminidase__InfluenzaA__ADF87305

SEQ ID NO: 49150 - RNA, 1410 nt, Artificial Sequence; identical to SEQ ID NO: 47562
  neuraminidase__InfluenzaA__ADF87334

SEQ ID NO: 49151 - RNA, 1410 nt, Artificial Sequence; identical to SEQ ID NO: 48836
  neuraminidase__InfluenzaA__ADF87344

SEQ ID NO: 49152 - RNA, 1410 nt, Artificial Sequence
  neuraminidase__InfluenzaA__ADF87354
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauuacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49153 - RNA, 1410 nt, Artificial Sequence
  neuraminidase__InfluenzaA__ADF87364
augaauccaaaccaaaagauaauaaccauugguucggucuguaugacaauuggaauggccaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguguaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguuucuuucaaccagaaucuggaauaucagauaggauacauaugcagugggauuuuuggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49154 - RNA, 1410 nt, Artificial Sequence; identical to SEQ ID NO: 48286
  neuraminidase__InfluenzaA__ADF87374

SEQ ID NO: 49155 - RNA, 1410 nt, Artificial Sequence
  neuraminidase__InfluenzaA__ADF87384
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49156 - RNA, 1410 nt, Artificial Sequence
  neuraminidase__InfluenzaA__ADF97251
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49157 - RNA, 1410 nt, Artificial Sequence
  neuraminidase__InfluenzaA__ADF97252
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49158 - RNA, 1410 nt, Artificial Sequence; identical to SEQ ID NO: 47242
  neuraminidase__InfluenzaA__ADF97253

SEQ ID NO: 49159 - RNA, 1410 nt, Artificial Sequence; identical to SEQ ID NO: 47242
  neuraminidase__InfluenzaA__ADF97254

SEQ ID NO: 49160 - RNA, 1410 nt, Artificial Sequence
  neuraminidase__InfluenzaA__ADF97255
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaaucacuucucaauaaagcaagauaucguaggaauaaaugaguggucaggauauagcgggaguuuuguucagcauccagaacuaacagggcuggauuguauaagaccuugcuucuggguugaacuaaucagagggcgaccuaaagagaacacaaucuggacuagcgggagcagcauauccuuuugugguguaaacagugacacuguggguuggucuuggccagacggugcugaguugccauuuaccauugacaaguaa

SEQ ID NO: 49161 - RNA, 1410 nt, Artificial Sequence; identical to SEQ ID NO: 47242
  neuraminidase__InfluenzaA__ADF97256

SEQ ID NO: 49162 - RNA, 1410 nt, Artificial Sequence; identical to SEQ ID NO: 47516
  neuraminidase__InfluenzaA__ADF97257

SEQ ID NO: 49163 - RNA, 1410 nt, Artificial Sequence
  neuraminidase__InfluenzaA__ADF97837
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuauuacuaugaggaaugcuccuguuauccugauucuagugaaaucacaugugugugcagggauaacuggcauggcucaaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49164 - RNA, 1410 nt, Artificial Sequence
  neuraminidase__InfluenzaA__ADG08120
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggaguccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49165 - RNA, 1350 nt, Artificial Sequence
  neuraminidase__InfluenzaA__ADG21408
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauuuaucucuuugucccguuagcggaugggcuguguacaguaaggacaacagcauaaggaucgguuccagaggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggccguauugaaauacaauggcauaauaacagacaccaucaagaguuggaggaacaauauaaugagaacucaggagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuuuuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 49166 - RNA, 1350 nt, Artificial Sequence
  neuraminidase__InfluenzaA__ADG21409
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49167 - RNA, 1350 nt, Artificial Sequence
  neuraminidase__InfluenzaA__ADG21415
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauauggggugaaaggguuuucauuuaaauacggcaaugguguuuggaucgggaggaccaaaaguacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49168 - RNA, 1350 nt, Artificial Sequence
  neuraminidase__InfluenzaA__ADG21417
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggggaaaucacaugugugugcagggauaauuggcauggaucaaauaggccauggguaucuuucaaucaaaauuuagaauaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49169 - RNA, 1350 nt, Artificial Sequence
  neuraminidase__InfluenzaA__ADG21419
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaucaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugggguaaauggugacacuguuaguuggucuuggccagacggugcugaguugccauucaccauugacaaguaa

SEQ ID NO: 49170 - RNA, 1350 nt, Artificial Sequence
  neuraminidase__InfluenzaA__ADG21423
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccaaggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacacuaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgagaucacaugugugugcagggauaguuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucaguaaagcaagauaucguagcaauaacugauuggucaggauauagcggaaguuuuguccagcauccagaacugacaggauuagauugcauaagaccuuguuucuggguugaguuaaucagaggacggccuaaagagagcacaauuuggaccaguggaagcagcauauccuuuugugguguaaauggugacacuguuaguuggucuuggccagacggugcugaguugccauucaccauugacaaguag

SEQ ID NO: 49171 - RNA, 1350 nt, Artificial Sequence
  neuraminidase__InfluenzaA__ADG21424
augaauccaaaucagaagauaauaaccaucggaucaaucuguaugguaauugggauagcuagcuuaauguuacaaauuggaaacaugaucucaauaugggucagucauucaauucagacagggaaucaaugccaagaugaaucaaucagcaacacuaaauuucuuacugagaaagcuguggcuucaguaacauuagcgggcaauucaucucuuugucccauuagcggaugggcuguguacaguaaggauaacagcauaaggaucgguuccaagggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugggguaaauggugacacuguuaguuggucuuggccagacggugcugaguugccauucaccauugacaaguaa

SEQ ID NO: 49172 - RNA, 1350 nt, Artificial Sequence
  neuraminidase__InfluenzaA__ADG21426
augaauccaaaucagaagauaauaaccaucggaucaaucuguaugguaauugggauaguuagcuuaauguuacaaauugggaacaugaucucaauaugggucagucauucaauucagacagagaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggacguguuuguuauaagagagccauucaucucaugcucccacuuggaaugcagaacuuucuuuuuaacccagggagccuuacugaaugacaagcacuccaaugggacugucaaggacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaggcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 49173 - RNA, 1350 nt, Artificial Sequence
  neuraminidase__InfluenzaA__ADG21428
augaauccaaaucagaagauaauaaccaucgggucaaucuguaugguaauugggauaguuagcuuaauguuacaaauugggaacaugaucucaauaugggucagucauccaauucagacagggaaucaaugccaagauaaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaaucacagacaccaucaagaguuggaggaacagcauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccaguguucccuaacggggcauacgggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49174 - RNA, 1350 nt, Artificial Sequence
  neuraminidase__InfluenzaA__ADG21430
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacuuuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugaggacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggggaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49175 - RNA, 1350 nt, Artificial Sequence
  neuraminidase__InfluenzaA__ADG21432
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccagaggggauguguuuguuauaagagagccguucaucucaugcucccacuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagcgcuugccaugauggcaccaguuggcugacaauuggaauuucugguccagacaauggggcuguggcuguauugaaauacaauggcauaauaacagacaccaucaagaguuggaggaacaacauaaugagaacccaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggugaaaucacgugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguuccccaacggggcauaugggguaaaaggauuuucauuuagauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuuuuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 49176 - RNA, 1350 nt, Artificial Sequence
  neuraminidase__InfluenzaA__ADG21438
augaauccaaaucagaagauaauaaccaucggaucaaucuguaugguaauugggauaguuagcuuaauguuacaaauugggaacaugaucucaauauggaucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggccguggcuguauugaaauacaauggcauaauaacagacaccaucaagaguuggaggaacaacauaaugagaacucaagagucugaaugcgcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggggaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcagugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49177 - RNA, 1350 nt, Artificial Sequence
  neuraminidase__InfluenzaA__ADG21440
augaauccaaaucagaagauaauaaccaucggaucaaucuguaugguaauugggauagcuagcuuaauguuacaaauugggaacaugaucucaauaugggucagucauucaauucagacagggaaucaaugccaagaugaaucaaucagcaacacuaaauuucuuacugagaaagcuguggcuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccuccccguauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugggguaaauggugacacuguuaguuggucuuggccagacggugcugaguugccauucacuauugacaaguaa

SEQ ID NO: 49178 - RNA, 1350 nt, Artificial Sequence
  neuraminidase__InfluenzaA__ADG21442
augaauccaaaucagaagauaauaaccaucggaucaaucuguaugguaauugggauaguuagcuuaauguuacaaauugggaauaugaucucaauaugggucagucauucaauucagacagggaaucaaugccaagaugaaccaaucagcaacacuaaauuucuuacugagaaagcuguggcuucgguaacauuagcgggcaauucaucucuuugucccauuagcggaugggcuguguacaguaaggauaacagcauaaggaucgguuccaggggggauguguuugugauaagagagccauucaucucaugcucccacuuggaaugcagaacuuucuucuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucaccugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49179 - RNA, 1350 nt, Artificial Sequence
  neuraminidase__InfluenzaA__ADG21444
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaucaaucagcaacacuaaauuucuuacugagaaagcugugacuucaguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuuuuuaacccagggagccuuacugaaugacaagcacuccaauggaacugucaaagacagaagcccucacagaacauuaaugaguuguccugugggugaggcucccucuccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggauaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagagcugacaggauuagauugcauaagaccuuguuucuggguugaguuaaucagagggcggccuaaagagagcacaauuuggaccaguggaagcagcauaucuuuuugugggguaaauggugacacuguuaguuggucuuggccagacggugcugaguugccauucaccauugacaaguaa

SEQ ID NO: 49180 - RNA, 1350 nt, Artificial Sequence
  neuraminidase__InfluenzaA__ADG21446
augaauccaaaucagaagauaauaaccaucggaucaaucuguaugguaauugggauaguuagcuuaauguuacaaauugggaauaugaucucaauaugggucagucauucaauucagacagggaaucaaugccaagaugaaccaaucagcaacacuaaauuucuuacugagaaagcuguggcuucgguaacauuagcgggcaauucaucucuuugucccauuagcggaugggcuguguacaguaaggauaacagcauaaggaucgguuccaggggggauguguuuguuauaagagagccauucaucucaugcucccacuuggaaugcagaacuuucuucuuaacccagggagccuuacugaaugacaagcacuccaauggaacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucaccugugugugcagggauaauuggcauggaucaaauaggccauggguaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucaguaaagcaagauaucguagcaauaacugauuggucaggauauagcgggaguuuuguccagcauccagaacugacaggauuagauugcauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguaa

SEQ ID NO: 49181 - RNA, 1350 nt, Artificial Sequence
  neuraminidase__InfluenzaA__ADG21448
augaauccaaaucagaagauaauaaccaucggaucaaucuguaugguaauugggauaguuagcuuaauguuacaaauugggaauaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccauuuggaaugcagaacuuucuuuuuaacccagggagccuuacugaaugacaagcacuccaaugggacugucaaagacagaagcccucacagaacauuaaugaguuguccugugggugaggcucccuccccauauaacucaagguuugagucuguugcuuggucagcaagugcuugccaugauggcaccaguugguugacaauuggaauuucugguccagacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggauaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauuguauaagaccuuguuucuggguugaguuaaucagagggcggccuaaagagagcacaauuuggaccaguggaagcagcauaucuuuuugugguguaaauggugacacuguuaguuggucuuggccagacggugcugaguugccauucaccauugacaaguag

SEQ ID NO: 49182 - RNA, 1350 nt, Artificial Sequence
  neuraminidase__InfluenzaA__ADG21450
augaauccaaaucagaagauaauaaccaucggaucaaucuguaugguaauugggauaguuagcuuaauguuacaaauugggaacaugaucucaauaugggucagucauucaauucagacagggaaucaaugccaagaugaaccaaucagcaacacuaaauuucuuacugagaaagcuguggcuucaguaacauuagcgggcaauucaucucuuugucccauuagcggaugggcuguguacaguaaggacaacagcauaaggaucgguuccaggggggauguguuuguuauaagagagccguucaucucaugcucccauuuggaaugcagaacuuucuuuuuaacccagggagccuuacugaaugacaagcacuccaaugggacugucaaagacagaagcccucacagaacauuaaugaguuguccugugggugaggcuccuuccccauauaacucaagguuugagucuguugcuuggucagcaagugcuugccaugauggcaccaguugguugacaauuggaauuucuggucccgacaauggggcuguggcuguauugaaauacaauggcauaauaacagacaccaucaagaguuggaggaacaacauaaugagaacucaagagucugaaugugcauguguaaauggcucuugcuuuacuguaaugacugauggaccaaguagugggcaggcaucauauaagaucuucaaaauggaaaagggaaaagugguuaaaucagucgaauuggaugcuccuaauuaucacuaugaggagugcuccuguuauccugaugccggcgaaaucacaugugugugcagggauaauuggcauggaucaaauaggccauggauaucuuucaaucaaaauuuggaguaucaaauaggauauauaugcaguggaguuuucggagacaauccacgccccaaugauggaacagguaguugugguccgguguucccuaacggggcauaugggguaaaaggguuuucauuuaaauacggcaaugguguuuggaucgggagaaccaaaagcacuaauuccaggagcggcuuugaaaugauuugggacccaaauggguggacuggaacggacaguagcuuuucagugaagcaagauaucguagcaauaacugauuggucaggauauagcgggaguuuuguccagcauccagaacugacaggauuagauuguauaagaccuuguuucuggguugaguuaaucagagggcggccuaaagagagcacaauuuggaccaguggaagcaguauaucuuuuugugguguaaauggugacacuguuaguuggucuuggccagacggugcugaguugccauucaccauugacaaguag

SEQ ID NO: 49183 - RNA, 1410 nt, Artificial Sequence; identical to SEQ ID NO: 47242
  neuraminidase__InfluenzaA__ADG27797

SEQ ID NO: 49184 - RNA, 1410 nt, Artificial Sequence
  neuraminidase__InfluenzaA__ADG27983
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaaucaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuauggguuggucuuggccagacggugcugaguugccauuuaccauugacaaguaa

SEQ ID NO: 49185 - RNA, 1410 nt, Artificial Sequence; identical to SEQ ID NO: 47562
  neuraminidase__InfluenzaA__ADG27989

SEQ ID NO: 49186 - RNA, 1410 nt, Artificial Sequence; identical to SEQ ID NO: 49184
  neuraminidase__InfluenzaA__ADG27998

SEQ ID NO: 49187 - RNA, 1410 nt, Artificial Sequence; identical to SEQ ID NO: 48515
  neuraminidase__InfluenzaA__ADG28013

SEQ ID NO: 49188 - RNA, 1410 nt, Artificial Sequence
  neuraminidase__InfluenzaA__ADG42086
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucaacauccagaacuaacagggcuggauuguauaagaccuugcuucuggguugaacuaaucagagggcgacccaaagagaacacaaucuggacuagcgggagcagcaucuccuuuugugguguaaacagugacacuguggguuggucuuggccagacggugcugaguugccauuuaccauugacaaguaa

SEQ ID NO: 49189 - RNA, 1410 nt, Artificial Sequence
  neuraminidase__InfluenzaA__ADG42096
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaauagguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49190 - RNA, 1410 nt, Artificial Sequence; identical to SEQ ID NO: 48819
  neuraminidase__InfluenzaA__ADG42106

SEQ ID NO: 49191 - RNA, 1410 nt, Artificial Sequence; identical to SEQ ID NO: 47439
  neuraminidase__InfluenzaA__ADG42116

SEQ ID NO: 49192 - RNA, 1410 nt, Artificial Sequence; identical to SEQ ID NO: 49099
  neuraminidase__InfluenzaA__ADG42126

SEQ ID NO: 49193 - RNA, 1410 nt, Artificial Sequence
  neuraminidase__InfluenzaA__ADG42136
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacagaagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggcuucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49194 - RNA, 1410 nt, Artificial Sequence; identical to SEQ ID NO: 48671
  neuraminidase__InfluenzaA__ADG42146

SEQ ID NO: 49195 - RNA, 1410 nt, Artificial Sequence; identical to SEQ ID NO: 47439
  neuraminidase__InfluenzaA__ADG42156

SEQ ID NO: 49196 - RNA, 1410 nt, Artificial Sequence; identical to SEQ ID NO: 47707
  neuraminidase__InfluenzaA__ADG42166

SEQ ID NO: 49197 - RNA, 1410 nt, Artificial Sequence
  neuraminidase__InfluenzaA__ADG42186
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugacggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49198 - RNA, 1410 nt, Artificial Sequence
  neuraminidase__InfluenzaA__ADG42196
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcugaacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49199 - RNA, 1410 nt, Artificial Sequence
  neuraminidase__InfluenzaA__ADG42206
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49200 - RNA, 1410 nt, Artificial Sequence
  neuraminidase__InfluenzaA__ADG42216
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaauugccauuuaccauugacaaguaa

SEQ ID NO: 49201 - RNA, 1410 nt, Artificial Sequence
  neuraminidase__InfluenzaA__ADG42226
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucaaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49202 - RNA, 1410 nt, Artificial Sequence
  neuraminidase__InfluenzaA__ADG42236
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaaaauagucaaaucagucgaaaugaaugccccuaauuaucacuaugaggaaugcuccuguuauccugauucuagugaaaucacaugugugugcagggacaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49203 - RNA, 1410 nt, Artificial Sequence; identical to SEQ ID NO: 48651
  neuraminidase__InfluenzaA__ADG42246

SEQ ID NO: 49204 - RNA, 1410 nt, Artificial Sequence
  neuraminidase__InfluenzaA__ADG42256
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucuuugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauauggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49205 - RNA, 1410 nt, Artificial Sequence; identical to SEQ ID NO: 48797
  neuraminidase__InfluenzaA__ADG42276

SEQ ID NO: 49206 - RNA, 1410 nt, Artificial Sequence
  neuraminidase__InfluenzaA__ADG42296
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagagcacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49207 - RNA, 1410 nt, Artificial Sequence
  neuraminidase__InfluenzaA__ADG42306
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucggacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccaaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49208 - RNA, 1410 nt, Artificial Sequence; identical to SEQ ID NO: 47439
  neuraminidase__InfluenzaA__ADG42316

SEQ ID NO: 49209 - RNA, 1410 nt, Artificial Sequence; identical to SEQ ID NO: 48596
  neuraminidase__InfluenzaA__ADG42326

SEQ ID NO: 49210 - RNA, 1410 nt, Artificial Sequence
  neuraminidase__InfluenzaA__ADG42336
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccaugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49211 - RNA, 1410 nt, Artificial Sequence
  neuraminidase__InfluenzaA__ADG42346
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguucccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49212 - RNA, 1410 nt, Artificial Sequence
  neuraminidase__InfluenzaA__ADG42356
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49213 - RNA, 1410 nt, Artificial Sequence
  neuraminidase__InfluenzaA__ADG42366
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucggcuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaaaaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggauaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaaauucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49214 - RNA, 1410 nt, Artificial Sequence
  neuraminidase__InfluenzaA__ADG42376
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuugggugaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49215 - RNA, 1410 nt, Artificial Sequence
  neuraminidase__InfluenzaA__ADG42386
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuugcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaaaugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaagcgguuuugagaugauuugggauccgaacggauggacugggacagacaauaaguucucaauaaagcaggauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49216 - RNA, 1410 nt, Artificial Sequence
  neuraminidase__InfluenzaA__ADG42396
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggacguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuaguaaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49217 - RNA, 1410 nt, Artificial Sequence
  neuraminidase__InfluenzaA__ADG42406
augaauccaaaccaaaagauaauaaccauugguucggucuguaugacaauuggaauggcuaacuuaauauuacaaauuggaaacauacucucaacauggauuagccacucaauucaacuugggaaucaaaaucagauugaaacaugcaaucaaagcgucauuacuuaugaaaacaacacuuggguaaaucagacauauguuaacaucaguaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49218 - RNA, 1410 nt, Artificial Sequence; identical to SEQ ID NO: 49212
  neuraminidase__InfluenzaA__ADG42426

SEQ ID NO: 49219 - RNA, 1410 nt, Artificial Sequence
  neuraminidase__InfluenzaA__ADG42436
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucggacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49220 - RNA, 1410 nt, Artificial Sequence
  neuraminidase__InfluenzaA__ADG42446
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgcgaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49221 - RNA, 1410 nt, Artificial Sequence
  neuraminidase__InfluenzaA__ADG42456
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccacaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49222 - RNA, 1410 nt, Artificial Sequence; identical to SEQ ID NO: 47306
  neuraminidase__InfluenzaA__ADG42466

SEQ ID NO: 49223 - RNA, 1410 nt, Artificial Sequence
  neuraminidase__InfluenzaA__ADG42476
augaauccaaaccaaaagauaauaaccauugguucggucuguaugacaauuggaauggcuaacuuaauauuacaaauuggaaacauaaucucaauauggauuagccacucaauucaacuugggaaucaaaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuagcggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49224 - RNA, 1410 nt, Artificial Sequence
  neuraminidase__InfluenzaA__ADG42486
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49225 - RNA, 1410 nt, Artificial Sequence
  neuraminidase__InfluenzaA__ADG42496
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucaaacauauguuaacaucagcaacaccaacuuugcugcuggacaaucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49226 - RNA, 1410 nt, Artificial Sequence
  neuraminidase__InfluenzaA__ADG42506
augaauccaaaccaaaagauaauaaucauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauauguagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49227 - RNA, 1410 nt, Artificial Sequence; identical to SEQ ID NO: 48417
  neuraminidase__InfluenzaA__ADG42516

SEQ ID NO: 49228 - RNA, 1410 nt, Artificial Sequence
  neuraminidase__InfluenzaA__ADG42526
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguuuaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugagcuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49229 - RNA, 1410 nt, Artificial Sequence
  neuraminidase__InfluenzaA__ADG42536
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaccagugacacuguggguuggucuuggccagacggugcugaguugccauuuaccauugacaaguaa

SEQ ID NO: 49230 - RNA, 1410 nt, Artificial Sequence
  neuraminidase__InfluenzaA__ADG42546
augaauccaaaccaaaagauaauaaccauugguucggucuguaugacaauuggaauggcuaacuuaauauuacaaauuggaaacauaaucucaauauggauuagccacucaauucaacuuggaaaucaaaaucagauugaaacaugcaaucaaagcgucauuacuuaugaaaacaacacuuggguaaaucagacauauguuaacaucagcaauaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacauguguaugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguagggauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49231 - RNA, 1410 nt, Artificial Sequence; identical to SEQ ID NO: 49230
  neuraminidase__InfluenzaA__ADG42556

SEQ ID NO: 49232 - RNA, 1410 nt, Artificial Sequence
  neuraminidase__InfluenzaA__ADG42566
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacauucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49233 - RNA, 1410 nt, Artificial Sequence
  neuraminidase__InfluenzaA__ADG42576
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggagccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccauacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaaugguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49234 - RNA, 1410 nt, Artificial Sequence; identical to SEQ ID NO: 47707
  neuraminidase__InfluenzaA__ADG42586

SEQ ID NO: 49235 - RNA, 1410 nt, Artificial Sequence
  neuraminidase__InfluenzaA__ADG42606
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccguaaaauuagcgggcaauuccucucucugcccuguuaguggaugggcuauauacaguaaagacaacaguauaagaaucgguuccaagggggauguguuugucauaagggaaccauucauaucaugcuccccuuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguauccuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuucccauugacaaguaa

SEQ ID NO: 49236 - RNA, 1410 nt, Artificial Sequence
  neuraminidase__InfluenzaA__ADG42616
augaauucaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucgugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccguggguaucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccggacggugcugaguugccauuuaccauugacaaguaa

SEQ ID NO: 49237 - RNA, 1410 nt, Artificial Sequence; identical to SEQ ID NO: 48671
  neuraminidase__InfluenzaA__ADG42626

SEQ ID NO: 49238 - RNA, 1410 nt, Artificial Sequence
  neuraminidase__InfluenzaA__ADG42636
augaauccaaaccaaaagauaauaaccauugguucggucuguaugacaauuggaauggcuaacuuaauauuacaaauuggaaacauaaucucaauauggauuagccacucaauucaacuugggaaucagaaucagacugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49239 - RNA, 1410 nt, Artificial Sequence
  neuraminidase__InfluenzaA__ADG42646
augaauccaaaccaaaggauaauaaccauugguucgguauguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguacccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49240 - RNA, 1410 nt, Artificial Sequence; identical to SEQ ID NO: 48596
  neuraminidase__InfluenzaA__ADG42656

SEQ ID NO: 49241 - RNA, 1410 nt, Artificial Sequence
  neuraminidase__InfluenzaA__ADG42666
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcaucauuacuuaugaaaacaacacuuggguaaaucaaacauauguuaacaucagcaacaccaacuuugcugcuggacagucagugguuuccgugaaauuggcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucagaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49242 - RNA, 1410 nt, Artificial Sequence
  neuraminidase__InfluenzaA__ADG42676
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaauaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49243 - RNA, 1410 nt, Artificial Sequence; identical to SEQ ID NO: 47242
  neuraminidase__InfluenzaA__ADG42686

SEQ ID NO: 49244 - RNA, 1410 nt, Artificial Sequence; identical to SEQ ID NO: 48819
  neuraminidase__InfluenzaA__ADG42696

SEQ ID NO: 49245 - RNA, 1410 nt, Artificial Sequence; identical to SEQ ID NO: 49126
  neuraminidase__InfluenzaA__ADG42706

SEQ ID NO: 49246 - RNA, 1410 nt, Artificial Sequence; identical to SEQ ID NO: 47242
  neuraminidase__InfluenzaA__ADG42716

SEQ ID NO: 49247 - RNA, 1410 nt, Artificial Sequence
  neuraminidase__InfluenzaA__ADG42726
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcaugcguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49248 - RNA, 1410 nt, Artificial Sequence; identical to SEQ ID NO: 49153
  neuraminidase__InfluenzaA__ADG42746

SEQ ID NO: 49249 - RNA, 1410 nt, Artificial Sequence; identical to SEQ ID NO: 48755
  neuraminidase__InfluenzaA__ADG42756

SEQ ID NO: 49250 - RNA, 1410 nt, Artificial Sequence; identical to SEQ ID NO: 48530
  neuraminidase__InfluenzaA__ADG42766

SEQ ID NO: 49251 - RNA, 1410 nt, Artificial Sequence
  neuraminidase__InfluenzaA__ADG42776
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagaaaggcaguugugguccaguaucgucuaauggagcaaauggaguaaaaggauuuucauucaaauacggcaaugguguuuggauagggagaaccaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49252 - RNA, 1410 nt, Artificial Sequence; identical to SEQ ID NO: 49251
  neuraminidase__InfluenzaA__ADG42796

SEQ ID NO: 49253 - RNA, 1410 nt, Artificial Sequence
  neuraminidase__InfluenzaA__ADG42806
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacugugaguuggucuuggccagacggugcugaguugccauuuaccauugacaaguaa

SEQ ID NO: 49254 - RNA, 1410 nt, Artificial Sequence; identical to SEQ ID NO: 47242
  neuraminidase__InfluenzaA__ADG42816

SEQ ID NO: 49255 - RNA, 1410 nt, Artificial Sequence
  neuraminidase__InfluenzaA__ADG42826
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuccugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggacuguauaagaccuugcuucuggguugaacuaaucagagggcgacccaaagagaacacaaucuggacuagcgggagcagcauaucuuuuugugguguaaacagugacacuguggguuggucuuggccagacggugcugaguugccauuuaccauugacaaguaa

SEQ ID NO: 49256 - RNA, 1410 nt, Artificial Sequence
  neuraminidase__InfluenzaA__ADG42836
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugaaaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49257 - RNA, 1410 nt, Artificial Sequence
  neuraminidase__InfluenzaA__ADG42846
augaauccaaaccaaaagauaauaaccauugguucggucuguaugacaauuggaauggcuaacuuaauauuacaaauuggaaacauaaucucaauauggauuagccacacaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49258 - RNA, 1410 nt, Artificial Sequence
  neuraminidase__InfluenzaA__ADG42856
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacccaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaauggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49259 - RNA, 1410 nt, Artificial Sequence; identical to SEQ ID NO: 48854
  neuraminidase__InfluenzaA__ADG42866

SEQ ID NO: 49260 - RNA, 1410 nt, Artificial Sequence; identical to SEQ ID NO: 47242
  neuraminidase__InfluenzaA__ADG42876

SEQ ID NO: 49261 - RNA, 1410 nt, Artificial Sequence; identical to SEQ ID NO: 48891
  neuraminidase__InfluenzaA__ADG42886

SEQ ID NO: 49262 - RNA, 1410 nt, Artificial Sequence; identical to SEQ ID NO: 48878
  neuraminidase__InfluenzaA__ADG42896

SEQ ID NO: 49263 - RNA, 1410 nt, Artificial Sequence
  neuraminidase__InfluenzaA__ADG42906
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaaaggggauguguuugucauaagggaaccauucauaucaugcucccccuuggaaugcagaaccuucuucuugacucaaggggccuugcuaaaugacaaacauuccaauggaaccauuaaagacaggagcucauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuuguuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauauggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49264 - RNA, 1410 nt, Artificial Sequence; identical to SEQ ID NO: 48286
  neuraminidase__InfluenzaA__ADG42916

SEQ ID NO: 49265 - RNA, 1410 nt, Artificial Sequence; identical to SEQ ID NO: 47439
  neuraminidase__InfluenzaA__ADG42926

SEQ ID NO: 49266 - RNA, 1410 nt, Artificial Sequence
  neuraminidase__InfluenzaA__ADG58909
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucaucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49267 - RNA, 1410 nt, Artificial Sequence; identical to SEQ ID NO: 47242
  neuraminidase__InfluenzaA__ADG58910

SEQ ID NO: 49268 - RNA, 1410 nt, Artificial Sequence
  neuraminidase__InfluenzaA__ADG58913
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugacuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49269 - RNA, 1410 nt, Artificial Sequence
  neuraminidase__InfluenzaA__ADG58914
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucgugggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49270 - RNA, 1410 nt, Artificial Sequence
  neuraminidase__InfluenzaA__ADG58916
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuuuuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggguacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49271 - RNA, 1410 nt, Artificial Sequence; identical to SEQ ID NO: 49269
  neuraminidase__InfluenzaA__ADG58917

SEQ ID NO: 49272 - RNA, 1410 nt, Artificial Sequence
  neuraminidase__InfluenzaA__ADG58918
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugacuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49273 - RNA, 1410 nt, Artificial Sequence
  neuraminidase__InfluenzaA__ADG58919
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucaucacuuaugaaaacaacacuuggguaaaucagacauauguuaacaucagcaacaccaacuuugcugcugggcagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacucuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcaugguucgaaucgaccgugggugacuuucaaccagaaucuggaauaucagauaggauacauaugcagugggauuuucggagacaauccacgcccuaaugauaaaacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggauugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49274 - RNA, 1410 nt, Artificial Sequence
  neuraminidase__InfluenzaA__ADG58920
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauauagaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugacugauggaccaaguaauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugacaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49275 - RNA, 1410 nt, Artificial Sequence; identical to SEQ ID NO: 49274
  neuraminidase__InfluenzaA__ADG58921

SEQ ID NO: 49276 - RNA, 1410 nt, Artificial Sequence; identical to SEQ ID NO: 49274
  neuraminidase__InfluenzaA__ADG58922

SEQ ID NO: 49277 - RNA, 1410 nt, Artificial Sequence; identical to SEQ ID NO: 49274
  neuraminidase__InfluenzaA__ADG58923

SEQ ID NO: 49278 - RNA, 1410 nt, Artificial Sequence; identical to SEQ ID NO: 49274
  neuraminidase__InfluenzaA__ADG58924

SEQ ID NO: 49279 - RNA, 1410 nt, Artificial Sequence; identical to SEQ ID NO: 49274
  neuraminidase__InfluenzaA__ADG58925

SEQ ID NO: 49280 - RNA, 1410 nt, Artificial Sequence; identical to SEQ ID NO: 49274
  neuraminidase__InfluenzaA__ADG58926

SEQ ID NO: 49281 - RNA, 1410 nt, Artificial Sequence; identical to SEQ ID NO: 49274
  neuraminidase__InfluenzaA__ADG58927

SEQ ID NO: 49282 - RNA, 1410 nt, Artificial Sequence
  neuraminidase__InfluenzaA__ADG58928
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucgugggaauaaaugaguggucaggauauagcgggaguuuuguucagcauccagaacuaacagggcugaauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49283 - RNA, 1410 nt, Artificial Sequence; identical to SEQ ID NO: 49282
  neuraminidase__InfluenzaA__ADG58929

SEQ ID NO: 49284 - RNA, 1410 nt, Artificial Sequence
  neuraminidase__InfluenzaA__ADG58931
augaauccaaaccaaaagauaauaaccauugguucggucuguaugacaauuggaauggcuaacuuaauauuacaaauuggaaacacaaucucaauauggauuaaccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49285 - RNA, 1410 nt, Artificial Sequence; identical to SEQ ID NO: 49284
  neuraminidase__InfluenzaA__ADG58932

SEQ ID NO: 49286 - RNA, 1410 nt, Artificial Sequence; identical to SEQ ID NO: 49284
  neuraminidase__InfluenzaA__ADG58933

SEQ ID NO: 49287 - RNA, 1410 nt, Artificial Sequence; identical to SEQ ID NO: 49284
  neuraminidase__InfluenzaA__ADG58934

SEQ ID NO: 49288 - RNA, 1410 nt, Artificial Sequence; identical to SEQ ID NO: 49284
  neuraminidase__InfluenzaA__ADG58935

SEQ ID NO: 49289 - RNA, 1410 nt, Artificial Sequence; identical to SEQ ID NO: 49284
  neuraminidase__InfluenzaA__ADG58936

SEQ ID NO: 49290 - RNA, 1410 nt, Artificial Sequence
  neuraminidase__InfluenzaA__ADG58937
augaauccaaaccaaaagauaauaaccauugguucggucugcaugacaauuggaauggcuaacuuaauauuacaaauuggaaacacaaucucaauauggauuaaccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuucacuguaaugaccgauggaccaagugauggacaggccucauacaagaucuucagaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaaggaacgguuuugagaugauuugggauccgaacggauggacugggacagacaauaacuucucaauaaagcaagauaucguaggaauaaaugaguggucaggauauagcgggaguuuuguucagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49291 - RNA, 1410 nt, Artificial Sequence; identical to SEQ ID NO: 49284
  neuraminidase__InfluenzaA__ADG58938

SEQ ID NO: 49292 - RNA, 1410 nt, Artificial Sequence
  neuraminidase__InfluenzaA__ADG59589
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaauggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucagaauagaaaagggaaagguagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguag

SEQ ID NO: 49293 - RNA, 1410 nt, Artificial Sequence; identical to SEQ ID NO: 47439
  neuraminidase__InfluenzaA__ADG59590

SEQ ID NO: 49294 - RNA, 1410 nt, Artificial Sequence; identical to SEQ ID NO: 47439
  neuraminidase__InfluenzaA__ADG59591

SEQ ID NO: 49295 - RNA, 1410 nt, Artificial Sequence; identical to SEQ ID NO: 47439
  neuraminidase__InfluenzaA__ADG59592

SEQ ID NO: 49296 - RNA, 1410 nt, Artificial Sequence
  neuraminidase__InfluenzaA__ADG59593
augaauccaaaccaaaagauaauaaccauugguucggucuguaugacaauuggaauggcuaacuuaauauuacaaauuggaaacauaaucucaauauggauuagccacucaauucaacuugggaaucaaaaucagauugaaacaugcaaucaaagcgucauuacuuaugaaaacaacacuuggguaaaucagacauauguuaacaucagcaacaccaacuuugcugcuggacagucagugguuuccgugaaauuagcgggcaauuccucucucugcccuguuaguggaugggcuauauacaguaaagacaacaguauaagaaucgguuccaagggggauguguuugucauaagggaaccauucauaucaugcucccccuuggaaugcagaaccuucuucuugacucaaggggccuugcuaaaugacaaacauuccaauggaaccauuaaagacaggagcccauaucgaacccuaaugagcuguccuauuggugaaguucccucuccauacaacucaagauuugagucagucgcuuggucagcaagugcuugucaugauggcaucaauuggcuaacaauuggaauuucuggcccagacaauggggcaguggcuguguuaaaguacaacggcauaauaacagacacuaucaagaguuggagaaacaauauauugagaacacaagagucugaaugugcauguguaaaugguucuugcuuuacuguaaugaccgauggaccaagugauggacaggccucauacaagaucuucaaaauagaaaagggaaagauagucaaaucagucgaaaugaaugccccuaauuaucacuaugaggaaugcuccuguuauccugauucuagugaaaucacaugugugugcagggauaacuggcauggcucgaaucgaccgugggugucuuucaaccagaaucuggaauaucagauaggauacauaugcagugggauuuucggagacaauccacgcccuaaugauaagacaggcaguugugguccaguaucgucuaauggagcaaauggaguaaaaggauuuucauucaaauacggcaaugguguuuggauagggagaacuaaaagcauuaguucaagaaacgguuuugagaugauuugggauccgaacggauggacugggacagacaauaacuucucaauaaagcaagauaucguaggaauaaaugaguggucaggauauagcgggaguuuuguccagcauccagaacuaacagggcuggauuguauaagaccuugcuucuggguugaacuaaucagagggcgacccaaagagaacacaaucuggacuagcgggagcagcauauccuuuugugguguaaacagugacacuguggguuggucuuggccagacggugcugaguugccauuuaccauugacaaguaa

SEQ ID NO: 49297 - RNA, 1410 nt, Artificial Sequence; identical to SEQ ID NO: 48419
  neuraminidase__InfluenzaA__ADG59594

SEQ ID NO: 49298 - RNA, 1410 nt, Artificial Sequence; identical to SEQ ID NO: 48419
  neuraminidase__InfluenzaA__ADG59595
